US008530221B2

(12) United States Patent
Hu et al.

(10) Patent No.: US 8,530,221 B2
(45) Date of Patent: Sep. 10, 2013

(54) PRODUCTION OF BRANCHED CHAIN FATTY ACIDS AND DERIVATIVES THEREOF IN RECOMBINANT MICROBIAL CELLS

(75) Inventors: Zhihao Hu, South San Francisco, CA (US); Grace J. Lee, South San Francisco, CA (US); Andreas W. Schirmer, South San Francisco, CA (US); Kseniya Zakharyevich, San Francisco, CA (US); Derek L. Greenfield, South San Francisco, CA (US); Tarah S. Baron, South San Francisco, CA (US); Kevin Holden, South San Francisco, CA (US)

(73) Assignee: LS9, Inc., South San Francisco, CA (US)

( * ) Notice: Subject to any disclaimer, the term of this patent is extended or adjusted under 35 U.S.C. 154(b) by 374 days.

(21) Appl. No.: 13/104,819

(22) Filed: May 10, 2011

(65) Prior Publication Data
US 2011/0244532 A1   Oct. 6, 2011

Related U.S. Application Data

(63) Continuation-in-part of application No. 13/006,933, filed on Jan. 14, 2011, now abandoned, and a continuation-in-part of application No. 13/007,100, filed on Jan. 14, 2011, now abandoned.

(60) Provisional application No. 61/294,846, filed on Jan. 14, 2010, provisional application No. 61/302,561, filed on Feb. 9, 2010, provisional application No. 61/294,847, filed on Jan. 14, 2010, provisional application No. 61/302,562, filed on Feb. 9, 2010.

(51) Int. Cl.
*C12N 1/00* (2006.01)
*C12N 1/20* (2006.01)
*C12P 1/00* (2006.01)

(52) U.S. Cl.
USPC ............................ 435/243; 435/252.3; 435/41

(58) Field of Classification Search
None
See application file for complete search history.

(56) References Cited

U.S. PATENT DOCUMENTS

| 2009/0081746 A1 | 3/2009 | Liao et al. |
| 2010/0154293 A1 | 6/2010 | Hom et al. |
| 2010/0209986 A1 | 8/2010 | Liao et al. |
| 2010/0242345 A1 | 9/2010 | Keasling et al. |

FOREIGN PATENT DOCUMENTS

| WO | WO 2005/123890 A1 | 12/2005 |
| WO | WO 2007/136762 A2 | 11/2007 |
| WO | WO 2008/098227 A2 | 8/2008 |
| WO | WO 2008/119082 A2 | 10/2008 |
| WO | WO 2008/130995 A1 | 10/2008 |
| WO | WO 2008/147781 A2 | 12/2008 |
| WO | WO 2009/085278 A1 | 11/2009 |
| WO | WO 2009/140695 A1 | 11/2009 |
| WO | WO 2010/042664 A2 | 6/2010 |
| WO | WO 2010/062480 A2 | 6/2010 |
| WO | WO 2010/075483 A2 | 7/2010 |
| WO | WO 2011/087787 A1 | 7/2011 |
| WO | WO 2011/100667 A1 | 8/2011 |

OTHER PUBLICATIONS

Atsumi et al., "Directed Evolution of *Methanococcus jannaschii* Citramalate Synthase for Biosynthesis of 1-Propanol and 1-Butanol by *Escherichia coli*", Appln.Environ.Microbiol. 74(24): 7802-7808 (2008).
Atsumi et al., "Non-fermentative pathways for synthesis of branched-chain higher alcohols as biofuels", Nature, 451: 86-89 (2008).
Cann et al., "Production of 2-methyl-1-butanol in engineered *Escherichia coli*", Appl Microbiol Biotechnol. 81: 89-98 (2008).
Choi et al., "β-Ketoacyl-acyl Carrier Protein Synthase III (FabH) Is a Determining Factor in Branched-Chain Fatty Acid Biosynthesis" *J. of Bacteriology* 182(2): 365-370 (2000).
Cropp et al., "Fatty-acid biosynthesis in a branched-chain α-keto acid dehydrogenase mutant of *Streptomyces avermitilis*", Can. J. Microbio. 46: 506-514 (2000).
Guillot, et al., "Expression of the *Escherichia coli* Catabolic Threonine Dehydratase in *Corynebacterium glutamicum* and its Effect on Isoleucine Production.", Appl. Environ. Microbiol. 65: 3100-3107 (1999).
Han et al., "A Novel Alternate Anaplerotic Pathway to the Glyoxylate Cycle in Streptomycetes," *J. Bacteriol.*, 179(16): 5157-5164 (1997).
Han et at., "Characterization of β-Ketoacyl-Acyl Carrier Protein Synthase III from *Streptomyces glaucescens* and its Role in Initiation of Fatty Acid Biosynthesis", J.Bacteriol. 180: 4481-4486 (1998).
Howell et al., "(*R*)-Citramalate Synthase in Methanogenic Archaea", *J. of Bacteriology* 181(1): 331-333 (1999).
Huber et al., "Branched-Chain Fatty Acids Produced by Mutants of *Streptomyces fradiae*, Putative Precursors of the Lactone Ring of Tylosin", Antimicrob.Agents.Chemother. 34(8)1535-1541 (1990).
Kalscheuer et al., "Microdiesel: *Escherichia coli* engineered for fuel production", Microbiol. 152(9): 2529-2536 (2006).
Kaneda, T., "Iso-and Anteiso-Fatty Acids in Bacteria: Biosynthesis, Function and Taxonomic Significance", *Microbiological Reviews, American Society for Microbiology*, 55(2): 288-302 (1991).
Kazakov et al., "Comparative Genomics of Regulation of Fatty Acid and Branched-Chain Amino Acid Utilization in Proteobacteria", *J. of Bacteriology 191(1)*:52-64 (2009).
Khandekar et al., "Identification, Substrate Specificity, and Inhibition of the *Streptococcus pneumoniae* β-Ketoacyl-Acyl Carrier Protein Synthase III (FabH)", *J. Biol. Chem* 276: 30024-30030 (2001).
Knothe, G., "Dependence of Biodiesel Fuel Properties on the Structure of Fatty Acid Alkyl Esters," *Fuel Process. Technol.*, 86: 1059-1070 (2005).

(Continued)

*Primary Examiner* — Suzanne M Noakes
*Assistant Examiner* — Jae W Lee
(74) *Attorney, Agent, or Firm* — Brigitte A. Hajos

(57) ABSTRACT

Recombinant microbial cells are provided which have been engineered to produce branched chain products such as branched fatty acid derivatives by the fatty acid biosynthetic pathway, and methods of making branched fatty acid derivatives using the recombinant microbial cells.

14 Claims, 8 Drawing Sheets

(56) References Cited

OTHER PUBLICATIONS

Kroumova et al., "A pathway for the biosynthesis of straight and branched, odd- and even-length, medium-chain fatty acids in plants", *PNAS 91*: 11437-11441 (1994).

Lee et al., Systems metabolic engineering of *Escherichia coli* for L-threonine production. Mol. Syst. Biol 3:149 (2007).

Lu et al., "Overproduction of free fatty acids in *E. coli*: Implications for biodiesel production", *Metabolic Engineering 10*: 333-339 (2008).

Nosova et al., "Characteristics of alcohol dehydrogenases of certain aerobic bacteria representing human colonic flora", *Alcohol Clin & Experimental Res. 21(3)*: 489-494 (1997).

Qiu et al., "Crystal structure and substrate specificity of the β-ketoacyl-acyl carrier protein synthase III (FabH) from *Staphylococcus aureus*", *Protein Science 14*: 2087-2094 (2005).

Ogawa-Miyata, Y., et al., "Mutation Analysis of the Feedback Inhibition Site of Aspartokinase III of *Escherichia coli* K-12 and its Use in L-threonine production", *Biosci. Biotechnol. Biochem. 65*: 1149-1154 (2001).

Singh et al. FabH selectivity for anteiso branched-chain fatty acid precursors in low-temperature adaptation in *Listeria monocytogenes*, FEMS Microbiol Lett. 2009; 201(2):1-8.

Smirnova et al., "Branched-Chain Fatty Acid Biosysthesis in *Escherichia coli*", *J. of Industrial Microbiology and Biotechnology 27(4)*: 246-251 (2001).

Sokatch, et al., "Purification of a branched-chain keto acid dehydrogenase from *Pseudomonas putida*", *J. Bacteriol. 148*: 647-652 (1981).

Xu, H., et al., "Isoleucine Biosynthesis in *Leptospira interrogans* Serotype lai Strain 56601 Proceeds via a Threonine-Independent Pathway" *J. Bacteriol. 186*: 5400-5409 (2004).

Zhang, et al., "Expanding metabolism for biosynthesis of nonnatural alcohols", *PNAS 105(52)*: 20653-20658 (2008).

International Search Report and Written Opinion from PCT/US2011/035979, mailed Dec. 23, 2011.

International Search Report and Written Opinion from PCT/US2011/02133, mailed Jun. 14, 2011.

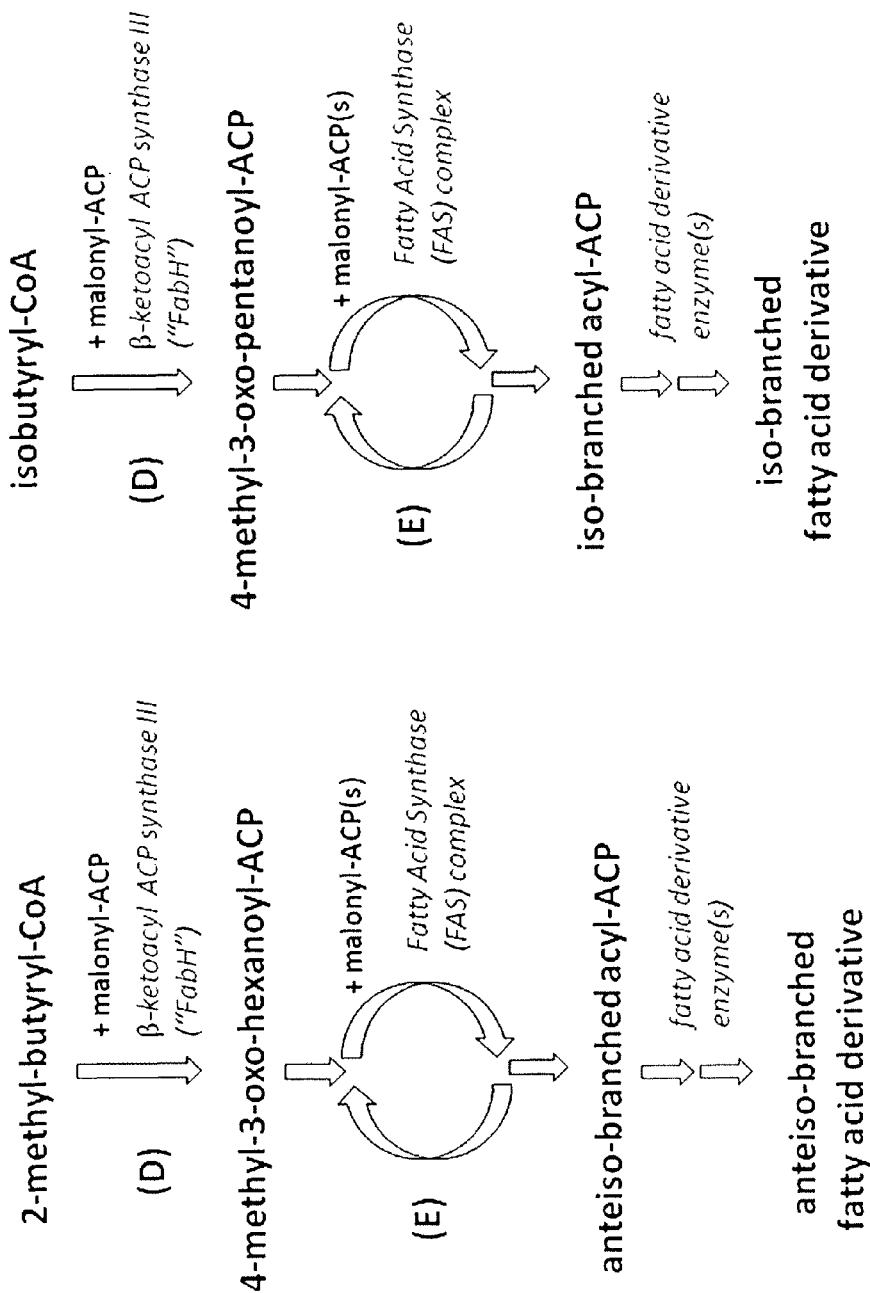

PRODUCTION OF BRANCHED CHAIN FATTY ACIDS AND DERIVATIVES THEREOF IN RECOMBINANT MICROBIAL CELLS

CROSS-REFERENCE TO RELATED APPLICATIONS

This application is a continuation-in-part of copending U.S. patent application Ser. No. 13/006,933, filed Jan. 14, 2011, which claims the benefit of U.S. Provisional Patent Application No. 61/302,561, filed Feb. 9, 2010 and U.S. Provisional Patent Application No. 61/294,846, filed Jan. 14, 2010, and this application is a continuation-in-part of copending U.S. patent application Ser. No. 13/007,100, filed Jan. 14, 2011, which claims the benefit of U.S. Provisional Patent Application No. 61/302,562, filed Feb. 9, 2010, and U.S. Provisional Patent Application No. 61/294,847, filed Jan. 14, 2010, the entire contents of which are hereby incorporated by reference.

INCORPORATION-BY-REFERENCE OF MATERIAL SUBMITTED ELECTRONICALLY

Incorporated by reference in its entirety herein is a computer-readable nucleotide/amino acid sequence listing submitted concurrently herewith and identified as follows: One 631,811 Byte ASCII (Text) file named "708119_ST25.TXT," created on May 10, 2011.

BACKGROUND

Crude petroleum is a very complex mixture containing a wide range of hydrocarbons. It is converted into a diversity of fuels and chemicals through a variety of chemical processes in refineries. Crude petroleum is a source of transportation fuels as well as a source of raw materials for producing petrochemicals. Petrochemicals are used to make specialty chemicals such as plastics, resins, fibers, elastomers, pharmaceuticals, lubricants, and gels.

Branched hydrocarbons, branched fatty acids and other branched chain fatty acid derivatives (including branched fatty esters, branched fatty aldehydes, and branched fatty alcohols) are known to have additional preferred properties when compared to straight-chain molecules of same molecular weight (i.e., isomers), such as considerably lower melting points which can in turn confer lower pour points when made into industrial chemicals. These additional benefits allow the branched hydrocarbons, branched fatty acids, and other branched fatty acid derivates to confer substantially lower volatility and vapor pressure, and improved stability against oxidation and rancidity, thus making them particularly suited as components or feedstock of cosmetic and pharmaceutical applications, or as components of plasticizers for synthetic resins, solvents for solutions for printing ink and specialty inks, and industrial lubricants.

Such additional preferred properties can also be obtained in unsaturated fatty acid derivatives (including unsaturated hydrocarbons, unsaturated fatty acids, and other unsaturated fatty acid derivates), typically with high degrees of unsaturation, but unsaturation promotes oxidation and can lead to short shelf lives and corrosion problems. Therefore, lower melting points, pour points, volatility, and vapor pressure, as well as improved oxidative stability, are better obtained through branching.

Obtaining branched specialty chemicals from crude petroleum requires a significant financial investment as well as a great deal of thermal energy. It is also an inefficient process because frequently the long chain hydrocarbons in crude petroleum are cracked to produce smaller monomers. These monomers are then used as the raw material to manufacture the more complex specialty chemicals. Furthermore, in the petrochemical industry, it is commonplace to obtain branched chemicals, such as, for example, branched alkanes, branched alkenes, branched fatty acids, branched fatty esters, branched fatty alcohols and branched fatty aldehydes by isomerization of straight-chain hydrocarbons, using various catalytic processes. Expensive catalysts are typically employed in these processes, therefore increasing the costs of manufacturing. The catalysts that are used often become undesirable contaminants that must be removed from the finished products, thus adding further costs to the processes.

The most important transportation fuels—gasoline, diesel, and jet fuel—contain distinctively different mixtures of hydrocarbons which are tailored toward optimal engine performance. For example, gasoline comprises predominantly straight chain, branched chain, and aromatic hydrocarbons ranging from about 4 to 12 carbon atoms, while diesel predominantly comprises straight chain hydrocarbons ranging from about 9 to 23 carbon atoms. Diesel fuel quality is evaluated by parameters such as cetane number, kinematic viscosity, oxidative stability, and cloud point (Knothe G., *Fuel Process Technol.* 86:1059-1070 (2005)). These parameters, among others, are impacted by the hydrocarbon chain length as well as by the degree of branching or saturation of the hydrocarbon.

Microbially-produced fatty acids and other fatty acid derivatives (such as fatty esters, fatty alcohols, and hydrocarbons) can be readily tailored by genetic manipulation. Metabolic engineering enables microbial strains to produce different mixtures of fatty acids and other fatty acid derivatives, which can be optimized in meeting or exceeding fuel standards, and can be tailored to produce other chemicals or precursor molecules that are typically petroleum derived.

There is a need for cost-effective alternatives to petroleum products that do not require exploration, extraction, transportation over long distances, substantial refinement, and avoid the types of environmental damage associated with processing of petroleum. For similar reasons, there is a need for alternative sources of chemicals which are typically derived from petroleum. There is also a need for efficient and cost-effective methods for producing high-quality biofuels, fuel alternatives, and industrial chemicals from renewable energy sources.

Recombinant microbial cells engineered to produce branched chain fatty acids and other branched chain fatty acid derivatives, methods using these recombinant microbial cells to produce branched chain fatty acid derivatives, and compositions produced by these methods, address these needs.

SUMMARY

The present invention provides novel recombinant microbial cells which produce branched chain fatty acid derivatives. The invention also provides methods of making branched chain fatty acid derivatives comprising culturing recombinant microbial cell of the invention, and other features apparent upon further review.

In a first aspect, the invention provides a recombinant microbial cell comprising: (a) polynucleotides encoding a branched chain alpha-keto acid dehydrogenase (BKD) complex, comprising polypeptides having branched-chain alpha-keto acid dehydrogenase activity, lipoamide acyltransferase activity, and dihydrolipoamide dehydrogenase activity, and (b) polynucleotides encoding a polypeptide having beta-ketoacyl-ACP synthase activity that utilizes a branched acyl-CoA molecule as a substrate, wherein at least one polynucleotide according to (a) or (b) encodes a polypeptide that is exogenous to the recombinant microbial cell or expression of said polynucleotide is modulated in the recombinant microbial cell; and comprising one or more polynucleotides each which encodes a polypeptide having fatty acid derivative enzyme activity, wherein the recombinant microbial cell produces a branched fatty acid derivative when cultured in the presence of a carbon source under conditions effective to express the polynucleotides. In some embodiments, expression of the at least one polynucleotide according to (a) or (b) is modulated by overexpression of the polynucleotide, such as by operatively linking the polynucleotide to an exogenous promoter.

In some embodiments, the recombinant microbial cell according to the first aspect produces a fatty acid derivative composition when the cell is cultured in a culture medium containing a carbon source under conditions effective to express the polynucleotides, the fatty acid derivative composition comprising straight chain fatty acid derivatives and branched chain fatty acid derivatives, and the branched chain fatty acid derivatives comprising anteiso-branched fatty acid derivatives and iso-branched fatty acid derivatives.

In some embodiments, at least 5%, at least 10%, at least 20%, at least 30%, at least 40%, at least 50%, at least 60%, at least 70%, at least 80% or at least 90% of the fatty acid derivatives in the composition produced by the microbial cell of the first aspect are branched chain fatty acid derivatives. In some embodiments, at least 10%, at least 20%, at least 30%, at least 40%, at least 50%, at least 60%, at least 70%, at least 80% or at least 90% of the branched chain fatty acid derivatives in the composition produced by the microbial cell of the first aspect are iso-branched fatty acid derivatives. In some embodiments, at least 10%, at least 20%, at least 30%, at least 40%, at least 50%, at least 60%, at least 70%, at least 80% or at least 90% of the branched fatty acid derivatives in the composition produced by the microbial cell of the first aspect are anteiso-branched fatty acid derivatives. In some embodiments, the recombinant microbial cell of the first aspect produces at least 10 mg/L, at least 25 mg/L, at least 100 mg/L, at least 200 mg/L, at least 500 mg/L, at least 1000 mg/L, or at least 2000 mg/L branched chain fatty acid derivatives when cultured in a culture medium containing a carbon source under conditions effective to express the polynucleotides.

In a second aspect, the invention provides a recombinant microbial cell comprising: (a) polynucleotides encoding a branched chain alpha-keto acid dehydrogenase (BKD) complex, comprising polypeptides having branched-chain alpha-keto acid dehydrogenase activity, lipoamide acyltransferase activity, and dihydrolipoamide dehydrogenase activity, and (b) polynucleotides encoding a polypeptide having beta-ketoacyl-ACP synthase activity that utilizes a branched acyl-CoA molecule as a substrate, and further comprising: (c) polynucleotides encoding polypeptides having aspartokinase activity, homoserine dehydrogenase activity, homoserine kinase activity, threonine synthase activity, and threonine deaminase activity, or (d) polynucleotides encoding polypeptides having (R)-citramalate synthase activity, isopropylmalate isomerase activity, and beta-isopropyl malate dehydrogenase activity, or (c) and (d); and (e) polynucleotides encoding polypeptides having acetohydroxyacid synthase activity, acetohydroxyacid isomeroreductase activity, and dihydroxy acid dehydratase activity; wherein at least one polynucleotide according to (a), (b), (c), (d), or (e) encodes a polypeptide that is exogenous to the recombinant microbial cell or expression of said polynucleotide is modulated in the recombinant microbial cell; and comprising one or more polynucleotides each which encodes a polypeptide having fatty acid derivative enzyme activity, wherein the recombinant microbial cell produces an anteiso-branched fatty acid derivative when cultured in the presence of a carbon source under conditions effective to express the polynucleotides. In some embodiments, expression of the at least one polynucleotide according to (a), (b), (c), (d), or (e) is modulated by overexpression of the polynucleotide, such as by operatively linking the polynucleotide to an exogenous promoter.

In some embodiments, the recombinant microbial cell according to the second aspect produces a fatty acid derivative composition when the cell is cultured in a culture medium containing a carbon source under conditions effective to express the polynucleotides, the fatty acid derivative composition comprising straight chain fatty acid derivatives and branched chain fatty acid derivatives, the branched chain fatty acid derivatives comprising anteiso-branched fatty acid derivatives and iso-branched fatty acid derivatives.

In some embodiments, at least 5%, at least 10%, at least 20%, at least 30%, at least 40%, at least 50%, at least 60%, at least 70%, at least 80% or at least 90% of the fatty acid derivatives in the composition produced by the recombinant microbial cell according to the second aspect are branched chain fatty acid derivatives. In some embodiments, at least 10%, at least 20%, at least 30%, at least 40%, at least 50%, at least 60%, at least 70%, at least 80% or at least 90% of the branched chain fatty acid derivatives in the composition produced by the microbial cell of the second aspect are anteiso-branched fatty acid derivatives. In some embodiments, the recombinant microbial cell of the second aspect produces at least 10 mg/L, at least 25 mg/L, at least 100 mg/L, at least 200 mg/L, at least 500 mg/L, at least 1000 mg/L, or at least 2000 mg/L branched chain fatty acid derivatives when cultured in a culture medium containing a carbon source under conditions effective to express the polynucleotides.

In some embodiments of the first aspect or the second aspect, the fatty acid derivative enzyme activity comprises thioesterase activity, and the branched chain fatty acid derivative produced by the recombinant microbial cell is a branched chain fatty acid. In some embodiments, the recombinant microbial cell produces a fatty acid composition comprising straight chain fatty acids and branched chain fatty acids, the branched chain fatty acids comprising anteiso-branched fatty acids and iso-branched fatty acids. In some embodiments, at least 5%, at least 10%, at least 20%, at least 30%, at least 40%, at least 50%, at least 60%, at least 70%, at least 80% or at least 90% of the fatty acids in the composition are branched fatty acids. In some embodiments, at least 10%, at least 20%, at least 30%, at least 40%, at least 50%, at least 60%, at least 70%, at least 80% or at least 90% of the branched chain fatty acids in the composition produced by the microbial cell are anteiso-branched fatty acids. In some embodiments, the recombinant microbial cell produces at least 10 mg/L, at least 25 mg/L, at least 100 mg/L, at least 200 mg/L, at least 500 mg/L, at least 1000 mg/L, or at least 2000 mg/L branched chain fatty acids or anteiso-branched chain fatty acids when cultured in a culture medium containing a carbon source under conditions effective to express the polynucleotides.

In some embodiments of the first aspect or the second aspect, the fatty acid derivative enzyme activity comprises ester synthase activity, and the branched chain fatty acid derivative produced by the recombinant microbial cell is a branched fatty ester. In some embodiments, the recombinant microbial cell produces a fatty ester composition comprising straight chain fatty esters and branched chain fatty esters, the branched chain esters comprising anteiso-branched fatty esters and iso-branched fatty esters. In some embodiments, at least 5%, at least 10%, at least 20%, at least 30%, at least 40%, at least 50%, at least 60%, at least 70%, at least 80% or at least 90% of the fatty esters in the composition are branched fatty esters. In some embodiments, at least 10%, at least 20%, at least 30%, at least 40%, at least 50%, at least 60%, at least 70%, at least 80% or at least 90% of the branched fatty esters in the composition produced by the microbial cell are anteiso-branched fatty esters or iso-branched fatty esters. In some embodiments, the recombinant microbial cell produces at least 10 mg/L, at least 25 mg/L, at least 100 mg/L, at least 200 mg/L, at least 500 mg/L, at least 1000 mg/L, or at least 2000 mg/L branched chain fatty esters or anteiso-branched fatty esters or iso-branched fatty esters when cultured in a culture medium containing a carbon source under conditions effective to express the polynucleotides.

In some embodiments of the first aspect or the second aspect, the fatty acid derivative enzyme activity comprises fatty aldehyde biosynthesis activity, and the branched chain fatty acid derivative produced by the recombinant microbial cell is a branched fatty aldehyde. In some embodiments, the recombinant microbial cell produces a fatty aldehyde composition comprising straight chain fatty aldehydes and branched chain fatty aldehydes, the branched fatty aldehydes comprising anteiso-branched fatty aldehydes and iso-branched fatty aldehydes. In some embodiments, at least 5%, at least 10%, at least 20%, at least 30%, at least 40%, at least 50%, at least 60%, at least 70%, at least 80% or at least 90% of the fatty aldehydes in the composition are branched fatty aldehydes. In some embodiments, at least 10%, at least 20%, at least 30%, at least 40%, at least 50%, at least 60%, at least 70%, at least 80% or at least 90% of the branched chain fatty aldehydes in the composition produced by the microbial cell are anteiso-branched fatty aldehydes or iso-branched fatty aldehydes. In some embodiments, the recombinant microbial cell produces at least 10 mg/L, at least 25 mg/L, at least 100 mg/L, at least 200 mg/L, at least 500 mg/L, at least 1000 mg/L, or at least 2000 mg/L branched chain fatty aldehydes or anteiso-branched fatty aldehydes or iso-branched fatty aldehydes when cultured in a culture medium containing a carbon source under conditions effective to express the polynucleotides.

In some embodiments of the first aspect or the second aspect, the fatty acid derivative enzyme activity comprises fatty alcohol biosynthesis activity, and the branched chain fatty acid derivative produced by the recombinant microbial cell is a branched fatty alcohol. In some embodiments, the recombinant microbial cell produces a fatty alcohol composition comprising straight chain fatty alcohols and branched chain fatty alcohols, the branched fatty alcohols comprising anteiso-branched fatty alcohols and iso-branched fatty alcohols. In some embodiments, at least 5%, at least 10%, at least 20%, at least 30%, at least 40%, at least 50%, at least 60%, at least 70%, at least 80% or at least 90% of the fatty alcohols in the composition are branched fatty alcohols. In some embodiments, at least 10%, at least 20%, at least 30%, at least 40%, at least 50%, at least 60%, at least 70%, at least 80% or at least 90% of the branched chain fatty alcohols in the composition produced by the microbial cell are anteiso-branched fatty alcohols or iso-branched fatty alcohols. In some embodiments, the recombinant microbial cell produces at least 10 mg/L, at least 25 mg/L, at least 100 mg/L, at least 200 mg/L, at least 500 mg/L, at least 1000 mg/L, or at least 2000 mg/L branched chain fatty alcohols or anteiso-branched fatty alcohols or iso-branched fatty alcohols when cultured in a culture medium containing a carbon source under conditions effective to express the polynucleotides.

In some embodiments of the first aspect or the second aspect, the fatty acid derivative enzyme activity comprises hydrocarbon biosynthesis activity, and the branched chain fatty acid derivative produced by the recombinant microbial cell is a branched hydrocarbon, such as a branched alkane, a branched terminal olefin or a branched internal olefin. In some embodiments, the recombinant microbial cell produces a hydrocarbon composition comprising straight chain hydrocarbons and branched chain hydrocarbons, the branched hydrocarbons comprising anteiso-branched hydrocarbons and iso-branched hydrocarbons. In some embodiments, at least 5%, at least 10%, at least 20%, at least 30%, at least 40%, at least 50%, at least 60%, at least 70%, at least 80% or at least 90% of the hydrocarbons in the composition are branched hydrocarbons. In some embodiments, at least 10%, at least 20%, at least 30%, at least 40%, at least 50%, at least 60%, at least 70%, at least 80% or at least 90% of the branched chain hydrocarbons in the composition produced by the microbial cell are anteiso-branched hydrocarbons or iso-branched hydrocarbons. In some embodiments, the recombinant microbial cell produces at least 10 mg/L, at least 25 mg/L, at least 100 mg/L, at least 200 mg/L, at least 500 mg/L, at least 1000 mg/L, or at least 2000 mg/L branched hydrocarbons or anteiso-branched hydrocarbons or iso-branched hydrocarbons when cultured in a culture medium containing a carbon source under conditions effective to express the polynucleotides.

In various embodiments, the carbon source comprises a monosaccharide, a disaccharide, or an oligosaccharide. In more preferred embodiments, the carbon source comprises a monosaccharide, preferably a hexose or a pentose, preferably a hexose such as glucose. In some embodiments, the carbon source is obtained from biomass, such as a cellulosic hydrolysate. In other embodiments, the carbon source comprises a branched short-chain carboxylic acid such as isobutyrate, isovalerate, or 2-methyl-butyrate.

In various embodiments, the host (e.g., parental) microbial cell is a filamentous fungi, an algae, a yeast, or a prokaryote such as a bacteria. In more preferred embodiments, the host cell is a bacterial cell. In particular embodiments the host cell is an *E. coli* cell or a *Bacillus* cell, preferably an *E. coli* cell.

In one embodiment, the recombinant microbial cell according to the first aspect or the second aspect comprises a polynucleotide encoding a polypeptide having branched-chain alpha-keto acid dehydrogenase activity which is categorized as EC 1.2.4.4. In some embodiments, the polypeptide having branched-chain alpha-keto acid dehydrogenase activity has an alpha subunit and a beta subunit, encoded by a bkdA and bkdB gene, a bkdAA and bkdAB gene, or a Pput_1453 and Pput_1452 gene. In one embodiment, the polypeptide having branched-chain alpha-keto acid dehydrogenase activity is endogenous to the parental microbial cell, or is exogenous to the parental microbial cell. In another embodiment, expression of the polynucleotide encoding the polypeptide having branched-chain alpha-keto acid dehydrogenase activity is modulated in the recombinant microbial cell. In some instances, expression of the polynucleotide is modulated by operatively linking the polynucleotide to an exogenous promoter, such that the polynucleotide is overexpressed in the recombinant microbial cell. In another embodiment, the polypeptide having branched-chain alpha-keto acid dehydrogenase activity comprises an alpha subunit and a beta subunit. In some embodiments, the alpha subunit comprises a sequence selected from SEQ ID NOs:1, 3, 5, 7, 9, 11, and 13, or a fragment or a variant thereof, or comprises one or more motif selected from SEQ ID NOs:15-21, wherein the alpha subunit combined with a beta subunit has branched-chain alpha-keto acid dehydrogenase activity, and which, when combined with a polypeptide having lipoamide acyltransferase activity and a polypeptide having dihydrolipoamide dehydrogenase activity, catalyzes the conversion of a branched alpha-keto acid to a branched acyl-CoA in vitro or in vivo, preferably in vivo. In some embodiments, the beta subunit comprises a sequence selected from SEQ ID NOs:22, 24, 26, 28, 30, 32, and 34, or a fragment or a variant thereof, or comprises one or more motif selected from SEQ ID NOs: 36-42, wherein the beta subunit combined with an alpha subunit has branched-chain alpha-keto acid dehydrogenase activity, and which, when combined with a polypeptide having lipoamide acyltransferase activity and a polypeptide having dihydrolipoamide dehydrogenase activity, catalyzes the conversion of a branched alpha-keto acid to a branched acyl-CoA in vitro or in vivo, preferably in vivo.

In one embodiment, the recombinant microbial cell according to the first aspect or the second aspect comprises a polynucleotide encoding a polypeptide having lipoamide acyltransferase activity which is categorized as EC 2.3.1.168. In some embodiments, the polypeptide having lipoamide acyltransferase activity is encoded by a bkdB, a bkdC, or a Pput__1451 gene. In one embodiment, the polypeptide having lipoamide acyltransferase activity is endogenous to the parental microbial cell, or is exogenous to the parental microbial cell. In another embodiment, expression of the polynucleotide encoding the polypeptide having lipoamide acyltransferase activity is modulated in the recombinant microbial cell. In some instances, expression of the polynucleotide is modulated by operatively linking the polynucleotide to an exogenous promoter, such that the polynucleotide is overexpressed in the recombinant microbial cell. In other embodiments, the polypeptide having lipoamide acyltransferase activity comprises a sequence selected from SEQ ID NOs:43, 45, 47, 49, 51, 53, and 55, or a variant or a fragment thereof having lipoamide acyltransferase activity, or comprises one or more sequence motif selected from SEQ ID NOs:57-62, and which, when combined with a polypeptide having dihydrolipoamide dehydrogenase activity and a polypeptide having branched-chain alpha-keto acid dehydrogenase activity, catalyzes the conversion of a branched alpha-keto acid to a branched acyl-CoA in vitro or in vivo, preferably in vivo.

In one embodiment, the recombinant microbial cell according to the first aspect or the second aspect comprises a polynucleotide encoding a polypeptide having lipoamide dehydrogenase activity which is categorized as EC 1.8.1.4. In some embodiments, the polypeptide having dihydrolipoamide dehydrogenase activity is encoded by a IpdV gene, a Pput__1450 gene or a IpdA gene. In one embodiment, the polypeptide having dihydrolipoamide dehydrogenase activity is endogenous to the parental microbial cell, or is exogenous to the parental microbial cell. In another embodiment, expression of the polynucleotide encoding the polypeptide having dihydrolipoamide dehydrogenase activity is modulated in the recombinant microbial cell. In some instances, expression of the polynucleotide is modulated by operatively linking the polynucleotide to an exogenous promoter, such that the polynucleotide is overexpressed in the recombinant microbial cell. In another embodiment, the polypeptide having dihydrolipoamide dehydrogenase activity comprises a sequence selected from SEQ ID NOs:63, 65, 67, 69, 71, 73, 75, and 77, or a variant or a fragment thereof having dihydrolipoamide dehydrogenase activity, or comprises one or more sequence motif selected from SEQ ID NOs:79-83 and which, when combined with a polypeptide having lipoamide acyltransferase activity and a polypeptide having branched-chain alpha-keto acid dehydrogenase activity, catalyzes the conversion of a branched alpha-keto acid to a branched acyl-CoA in vitro or in vivo, preferably in vivo.

In one embodiment, the recombinant microbial cell according to the first aspect or the second aspect comprises a polynucleotide encoding a polypeptide having beta-ketoacyl-ACP synthase activity and utilizes a branched acyl-CoA molecule as a substrate, preferably a beta-ketoacyl-ACP synthase III activity categorized as EC 2.3.1.180. In one embodiment, the polypeptide having beta-ketoacyl-ACP synthase activity is encoded by a fabH gene. In one embodiment, the polypeptide having beta-ketoacyl-ACP synthase activity is endogenous to the parental microbial cell, or is exogenous to the parental microbial cell. In another embodiment, expression of the polynucleotide encoding the polypeptide having beta-ketoacyl-ACP synthase activity is modulated in the recombinant microbial cell. In some instances, expression of the polynucleotide is modulated by operatively linking the polynucleotide to a strong promoter, such that the polynucleotide is overexpressed in the recombinant microbial cell. In another embodiment, the polypeptide having beta-ketoacyl-ACP synthase activity comprises a sequence selected from SEQ ID NOs:84, 86, 88, 90, 92, 94, 96, 98, 100, 102, 104, 106, and 108, or a variant or a fragment thereof having beta-ketoacyl-ACP synthase activity, or comprises one or more sequence motif selected from SEQ ID NOs:110-115, and which catalyzes the condensation of a branched acyl-CoA with malonyl-ACP to form a branched acyl-ACP in vitro or in vivo, preferably in vivo.

In one embodiment, the recombinant microbial cell according to the first aspect or the second aspect comprises an endogenous polynucleotide sequence (such as, an endogenous fabH gene) encoding a polypeptide having beta-ketoacyl-ACP synthase activity that does not utilize a branched acyl-CoA molecule as a substrate, and expression of the endogenous polynucleotide sequence in the recombinant microbial cell is attenuated. In some embodiments, expression of the endogenous polynucleotide is attenuated by deletion of all or part of the sequence of the endogenous polynucleotide in the recombinant microbial cell.

In another embodiment, the recombinant microbial cell according to the first aspect or the second aspect comprises an endogenous polynucleotide sequence (such as, an endogenous fadE gene) encoding a polypeptide having acyl-CoA dehydrogenase activity, and expression of the endogenous polynucleotide in the recombinant microbial cell is attenuated. In some embodiments, expression of the endogenous polynucleotide is attenuated by deletion of all or part of the sequence of the endogenous polynucleotide in the recombinant microbial cell.

In one embodiment, the recombinant microbial cell according to the second aspect comprises a polynucleotide encoding a polypeptide having aspartokinase activity which is categorized as EC 2.7.2.4. In some embodiments, the polypeptide having aspartokinase activity is encoded by a thrA, a dapG or a hom3 gene. In one embodiment, the polypeptide having aspartokinase activity is endogenous to the parental microbial cell, or is exogenous to the parental microbial cell. In another embodiment, expression of the polynucleotide encoding the polypeptide having aspartokinase activity is modulated in the recombinant microbial cell. In some instances, expression of the polynucleotide is modulated by operatively linking the polynucleotide to an exogenous promoter, such that the polynucleotide is overexpressed in the recombinant microbial cell. In another embodiment, the polypeptide having aspartokinase activity comprises a sequence selected from SEQ ID NOs:116, 118, 120, 122, 124, or a variant or a fragment thereof having aspartokinase activity and which catalyzes the conversion of aspartate to aspartyl phosphate in vitro or in vivo, preferably in vivo.

In one embodiment, the recombinant microbial cell according to the second aspect comprises a polynucleotide encoding a polypeptide having homoserine dehydrogenase activity which is categorized as EC 1.1.1.3. In some embodiments, the polypeptide having homoserine dehydrogenase activity is encoded by a thrA, a hom or a hom6 gene. In one embodiment, the polypeptide having homoserine dehydrogenase activity is endogenous to the parental microbial cell, or is exogenous to the parental microbial cell. In another embodiment, expression of the polynucleotide encoding the polypeptide having homoserine dehydrogenase activity is modulated in the recombinant microbial cell. In some instances, expression of the polynucleotide is modulated by operatively linking the polynucleotide to an exogenous promoter, such that the polynucleotide is overexpressed in the recombinant microbial cell. In another embodiment, the polypeptide having homoserine dehydrogenase activity comprises a sequence selected from SEQ ID NOs:116, 118, 126, 128, and 130, or a variant or a fragment thereof having homoserine dehydrogenase activity and which catalyzes the conversion of aspartate semialdehyde to homoserine in vitro or in vivo, preferably in vivo.

In a particular embodiment, the recombinant microbial cell according to the second aspect comprises a polynucleotide encoding a polypeptide having aspartokinase and homoserine dehydrogenase activity. In one embodiment, the polypeptide having aspartokinase and homoserine dehydrogenase activity is endogenous to the parental microbial cell, or is exogenous to the parental microbial cell. In another embodiment, expression of the polynucleotide encoding the polypeptide having aspartokinase and homoserine dehydrogenase activity is modulated in the recombinant microbial cell. In some instances, expression of the polynucleotide is modulated by operatively linking the polynucleotide to an exogenous promoter, such that the polynucleotide is overexpressed in the recombinant microbial cell. In one embodiment the polypeptide having aspartokinase and homoserine dehydrogenase activity comprises the sequence SEQ ID NO:116, or a variant or a fragment thereof, such as SEQ ID NO:118, which catalyzes the conversion of aspartate to aspartyl phosphate and the conversion of aspartate semialdehyde to homoserine in vitro or in vivo, preferably in vivo.

In one embodiment, the recombinant microbial cell according to the second aspect comprises a polynucleotide encoding a polypeptide having homoserine kinase activity which is categorized as EC 2.7.1.39. In some embodiments, the polypeptide having homoserine kinase activity is encoded by a thrB gene or a thr1 gene. In one embodiment, the polypeptide having homoserine kinase activity is endogenous to the parental microbial cell, or is exogenous to the parental microbial cell. In another embodiment, expression of the polynucleotide encoding the polypeptide having homoserine kinase activity is modulated in the recombinant microbial cell. In some instances, expression of the polynucleotide is modulated by operatively linking the polynucleotide to an exogenous promoter, such that the polynucleotide is overexpressed in the recombinant microbial cell. In another embodiment, the polypeptide having homoserine kinase activity comprises a sequence selected from SEQ ID NOs:132, 134, 136, 138, or a variant or a fragment thereof having homoserine kinase activity and which catalyzes the conversion of homoserine to O-phospho-L-homoserine in vitro or in vivo, preferably in vivo.

In one embodiment, the recombinant microbial cell according to the second aspect comprises a polynucleotide encoding a polypeptide having threonine synthase activity which is categorized as EC 4.2.3.1. In one embodiment, the polypeptide having threonine synthase activity is encoded by a thrC gene. In one embodiment, the polypeptide having threonine synthase activity is endogenous to the parental microbial cell, or is exogenous to the parental microbial cell. In another embodiment, expression of the polynucleotide encoding the polypeptide having threonine synthase activity is modulated in the recombinant microbial cell. In some instances, expression of the polynucleotide is modulated by operatively linking the polynucleotide to an exogenous promoter, such that the polynucleotide is overexpressed in the recombinant microbial cell. In another embodiment, the polypeptide having threonine synthase activity comprises a sequence selected from SEQ ID NOs:140, 143, 144, or a variant or a fragment thereof having threonine synthase activity and which catalyzes the conversion of O-phospho-L-homoserine to threonine in vitro or in vivo, preferably in vivo.

In one embodiment, the recombinant microbial cell according to the second aspect comprises a polynucleotide encoding a polypeptide having threonine deaminase activity which is categorized as EC 4.3.1.19. In some embodiments, the polypeptide having threonine deaminase activity is encoded by a tdcB gene or an ilvA gene. In one embodiment, the polypeptide having threonine deaminase activity is endogenous to the parental microbial cell, or is exogenous to the parental microbial cell. In another embodiment, expression of the polynucleotide encoding the polypeptide having threonine deaminase activity is modulated in the recombinant microbial cell. In some instances, expression of the polynucleotide is modulated by operatively linking the polynucleotide to an exogenous promoter, such that the polynucleotide is overexpressed in the recombinant microbial cell. In another embodiment, the polypeptide having threonine deaminase activity comprises a sequence selected from SEQ ID NOs: 146, 148, 150, 152, and 154, or a variant or a fragment thereof having threonine deaminase activity and which catalyzes the conversion of threonine to 2-ketobutyrate in vitro or in vivo, preferably in vivo.

In one embodiment, the recombinant microbial cell according to the second aspect comprises a polynucleotide encoding a polypeptide having (R)-citramalate synthase activity which is categorized as EC 2.3.1.182. In one embodiment, the polypeptide having (R)-citramalate synthase activity is encoded by a cimA gene. In one embodiment, the polypeptide having (R)-citramalate synthase activity is endogenous to the parental microbial cell, or is exogenous to the parental microbial cell. In another embodiment, expression of the polynucleotide encoding the polypeptide having (R)-citramalate synthase activity is modulated in the recombinant microbial cell. In some instances, expression of the polynucleotide is modulated by operatively linking the polynucleotide to an exogenous promoter, such that the polynucleotide is overexpressed in the recombinant microbial cell. In another embodiment, the polypeptide having (R)-citramalate synthase activity comprises a sequence selected from SEQ ID NOs:156, 158, 160, and 162, or a variant or a fragment thereof having (R)-citramalate synthase activity and which catalyzes the reaction of acetyl-CoA and pyruvate to (R)-citramalate in vitro or in vivo, preferably in vivo.

In one embodiment, the recombinant microbial cell according to the second aspect comprises a polynucleotide encoding a polypeptide having isopropylmalate isomerase activity which is categorized as EC 4.2.1.33. In one embodiment, the polypeptide having isopropylmalate isomerase activity comprises a large subunit and a small subunit encoded by leuCD genes. In one embodiment, the polypeptide having isopropylmalate isomerase activity is endogenous to the parental microbial cell, or is exogenous to the parental microbial cell. In another embodiment, expression of the polynucleotide encoding the polypeptide having isopropylmalate isomerase activity is modulated in the recombinant microbial cell. In some instances, expression of the polynucleotide is modulated by operatively linking the polynucleotide to an exogenous promoter, such that the polynucleotide is overexpressed in the recombinant microbial cell. In another embodiment, the polypeptide having isopropylmalate isomerase activity comprises a large subunit and a small subunit. In other embodiments, the polypeptide having isopropylmalate isomerase activity comprises a large subunit sequence selected from SEQ ID NOs:164 and 168 and a small subunit sequence selected from SEQ ID NOs:166 and 170, or variants or fragments thereof having isopropylmalate isomerase activity and which catalyzes the conversion of (R)-citramalate to citraconate and citraconate to beta-methyl-D-malate in vitro or in vivo, preferably in vivo.

In one embodiment, the recombinant microbial cell according to the second aspect comprises a polynucleotide encoding a polypeptide having beta-isopropylmalate dehydrogenase activity which is categorized as EC 1.1.1.85. In some embodiments, the polypeptide having beta-isopropyl malate dehydrogenase activity is encoded by a leuB gene or a leu2 gene. In one embodiment, the polypeptide having beta-isopropylmalate dehydrogenase activity is endogenous to the parental microbial cell, or is exogenous to the parental microbial cell. In another embodiment, expression of the polynucleotide encoding the polypeptide having beta-isopropylmalate dehydrogenase activity is modulated in the recombinant microbial cell. In some instances, expression of the polynucleotide is modulated by operatively linking the polynucleotide to an exogenous promoter, such that the polynucleotide is overexpressed in the recombinant microbial cell. In another embodiment, the polypeptide having beta-isopropyl malate dehydrogenase activity comprises a sequence selected from SEQ ID NOs:172, 174, 176, or a variant or a fragment thereof having beta-isopropylmalate dehydrogenase activity and which catalyzes conversion of beta-methyl-D-malate to 2-ketobutyrate in vitro or in vivo, preferably in vivo.

In one embodiment, the recombinant microbial cell according to the second aspect comprises a polynucleotide encoding a polypeptide having acetohydroxyacid synthase activity which is categorized as EC 2.2.1.6. In some embodiments, the polypeptide having acetohydroxyacid synthase activity comprises a large subunit and a small subunit encoded by ilvBN genes, ilvGM genes or ilvIH genes. In one embodiment, the polypeptide having acetohydroxyacid synthase activity is endogenous to the parental microbial cell, or is exogenous to the parental microbial cell. In another embodiment, expression of the polynucleotide encoding the polypeptide having acetohydroxyacid synthase activity is modulated in the recombinant microbial cell. In some instances, expression of the polynucleotide is modulated by operatively linking the polynucleotide to an exogenous promoter, such that the polynucleotide is overexpressed in the recombinant microbial cell. In another embodiment, the polypeptide having acetohydroxyacid synthase activity comprises a sequence selected from SEQ ID NOs:178, 180, 182, 184, 186, 188, 190, and 192, or a variant or a fragment thereof having acetohydroxyacid synthase activity and which catalyzes the conversion of 2-ketobutyrate to 2-keto-3-methylvalerate in vitro or in vivo, preferably in vivo.

In one embodiment, the recombinant microbial cell according to the second aspect comprises a polynucleotide encoding a polypeptide having acetohydroxyacid isomeroreductase activity which is categorized as EC 1.1.1.86. In some embodiments, the polypeptide having acetohydroxyacid isomeroreductase activity is encoded by an ilvC gene or an ilv5 gene. In one embodiment, the polypeptide having acetohydroxyacid isomeroreductase activity is endogenous to the parental microbial cell, or is exogenous to the parental microbial cell. In another embodiment, expression of the polynucleotide encoding the polypeptide having acetohydroxyacid isomeroreductase activity is modulated in the recombinant microbial cell. In some instances, expression of the polynucleotide is modulated by operatively linking the polynucleotide to an exogenous promoter, such that the polynucleotide is overexpressed in the recombinant microbial cell. In another embodiment, the polypeptide having acetohydroxyacid isomeroreductase activity comprises a sequence selected from SEQ ID NOs:194 and 196, or a variant or a fragment thereof having acetohydroxyacid isomeroreductase activity and which catalyzes the conversion of 2-aceto-2-hydroxybutyrate to 2,3-dihydroxy-3-methylvalerate in vitro or in vivo, preferably in vivo.

In one embodiment, the recombinant microbial cell according to the second aspect comprises a polynucleotide encoding a polypeptide having dihydroxy acid dehydratase activity which is categorized as EC 4.2.1.9. In some embodiments, the polypeptide having acetohydroxyacid isomeroreductase activity is encoded by an ilvD gene or an ilv3 gene. In one embodiment, the polypeptide having dihydroxy acid dehydratase activity is endogenous to the parental microbial cell, or is exogenous to the parental microbial cell. In another embodiment, expression of the polynucleotide encoding the polypeptide having dihydroxy acid dehydratase activity is modulated in the recombinant microbial cell. In some instances, expression of the polynucleotide is modulated by operatively linking the polynucleotide to an exogenous promoter, such that the polynucleotide is overexpressed in the recombinant microbial cell. In another embodiment, the polypeptide having dihydroxy acid dehydratase activity comprises a sequence selected from SEQ ID NO:198 and 200, or a variant or a fragment thereof having dihydroxy acid dehydratase activity and which catalyzes the conversion of 2,3-dihydroxy-3-methylvalerate to 2-keto-3-methylvalerate in vitro or in vivo, preferably in vivo.

In other embodiments, a recombinant microbial cell according to the first aspect or the second aspect further comprises one or more polynucleotides encoding one or more polypeptides each having a fatty acid derivative enzyme activity, wherein the recombinant microbial cell produces a branched chain fatty acid derivative when cultured in the presence of a carbon source.

In various embodiments, the fatty acid derivative enzyme activity comprises a thioesterase activity, an ester synthase activity, a fatty aldehyde biosynthesis activity, a fatty alcohol biosynthesis activity, a ketone biosynthesis activity, and/or a hydrocarbon biosynthesis activity. In some embodiments, the recombinant microbial cell comprises polynucleotides encoding two or more polypeptides, each polypeptide having a fatty acid derivative enzyme activity. In more particular embodiments, the recombinant microbial cell expresses or overexpresses one or more polypeptides having fatty acid derivative enzyme activity selected from: (1) a polypeptide having thioesterase activity; (2) a polypeptide having decarboxylase activity; (3) a polypeptide having carboxylic acid reductase activity; (4) a polypeptide having alcohol dehydrogenase activity (EC 1.1.1.1); (5) a polypeptide having aldehyde decarbonylase activity (EC 4.1.99.5); (6) a polypeptide having acyl-CoA reductase activity (EC 1.2.1.50); (7) a polypeptide having acyl-ACP reductase activity; (8) a polypeptide having ester synthase activity (EC 3.1.1.67); (9) a polypeptide having OleA activity; or (10) a polypeptide having OleCD or OleBCD activity; wherein the recombinant microbial cell produces a composition comprising branched fatty acids, branched fatty esters, branched wax esters, branched fatty aldehydes, branched fatty alcohols, branched alkanes, branched alkenes, branched internal olefins, branched terminal olefins, or branched ketones.

In one embodiment, the fatty acid derivative enzyme activity is a thioesterase activity, and the branched chain fatty acid derivative is a branched chain fatty acid, wherein a culture comprising the recombinant microbial cell produces a branched chain fatty acid composition when cultured in the presence of a carbon source. In some embodiments, the polypeptide has a thioesterase activity which is categorized as EC 3.1.1.5, EC 3.1.2.-, or EC 3.1.2.14. In some embodiments, the polypeptide having a thioesterase activity is encoded by a tesA, a tesB, a fatA, or a fatB gene. In one embodiment, the polypeptide having thioesterase activity is endogenous to the parental microbial cell, or is exogenous to the parental microbial cell. In another embodiment, expression of the polynucleotide encoding the polypeptide having thioesterase activity is modulated in the recombinant microbial cell. In some instances, expression of the polynucleotide is modulated by operatively linking the polynucleotide to an exogenous promoter, such that the polynucleotide is overexpressed in the recombinant microbial cell. In another embodiment, the polypeptide having thioesterase activity comprises a sequence selected from SEQ ID NO: 202, 204, 206, 208, 210, 212, 214, 216, 218, 220, 222, and 224, or a variant or a fragment thereof having thioesterase activity and which catalyzes the hydrolysis of a branched acyl-ACP to a branched fatty acid, or catalyzes the alcoholysis of a branched acyl-ACP to a branched fatty ester, in vitro or in vivo, preferably in vivo. In some embodiments, the recombinant microbial cell according to the first aspect or the second aspect, further comprising a polynucleotide encoding a polypeptide having thioesterase activity, when cultured in the presence of a carbon source, produces at least 10 mg/L, at least 25 mg/L, at least 100 mg/L, at least 200 mg/L, at least 500 mg/L, at least 1000 mg/L, or at least 2000 mg/L branched chain fatty acids or anteiso-branched chain fatty acids when cultured in a culture medium containing a carbon source under conditions effective to express the polynucleotides. In some embodiments, the recombinant microbial cell according to the first aspect or the second aspect, further comprising a polynucleotide encoding a polypeptide having thioesterase activity, produces a fatty acid composition comprising straight chain fatty acids and branched chain fatty acids, the branched chain fatty acids comprising anteiso-branched fatty acids and iso-branched fatty acids. In some embodiments, at least 5%, at least 10%, at least 20%, at least 30%, at least 40%, at least 50%, at least 60%, at least 70%, at least 80% or at least 90% of the fatty acids in the composition are branched fatty acids. In some embodiments, at least 10%, at least 20%, at least 30%, at least 40%, at least 50%, at least 60%, at least 70%, at least 80% or at least 90% of the branched chain fatty acids in the composition produced by the microbial cell are anteiso-branched fatty acids.

In a third aspect, the invention includes a method of making a composition comprising a branched fatty acid derivative, the method comprising: obtaining a recombinant microbial cell comprising: (a) polynucleotides encoding a branched chain alpha-keto acid dehydrogenase (BKD) complex, comprising polypeptides having branched-chain alpha-keto acid dehydrogenase activity, lipoamide acyltransferase activity, and dihydrolipoamide dehydrogenase activity, and (b) a polynucleotide encoding a polypeptide having beta-ketoacyl-ACP synthase activity that utilizes a branched acyl-CoA molecule as a substrate, wherein at least one polynucleotide according to (a) or (b) encodes a polypeptide that is exogenous to the parental microbial cell or expression of said polynucleotide is modulated in the recombinant microbial cell; the recombinant microbial cell further comprising one or more polynucleotides each which encodes a polypeptide having fatty acid derivative enzyme activity, wherein the recombinant microbial cell produces a branched chain fatty acid derivative when cultured in the presence of a carbon source under conditions effective to express the polynucleotides; culturing the recombinant microbial cell in a culture medium containing a carbon source under conditions effective to express the polynucleotides and produce a fatty acid derivative composition comprising straight-chain fatty acid derivatives and branched fatty acid derivatives, and optionally recovering the composition from the culture medium.

In some embodiments, the fatty acid derivative composition produced by the recombinant cell comprises branched fatty acid derivatives, wherein at least 10%, at least 20%, at least 30%, at least 40%, at least 50%, at least 60%, at least 70%, at least 80% or at least 90% by weight of the fatty acid derivatives in the composition are branched fatty acid derivatives. In some embodiments, the fatty acid derivative composition comprises branched fatty acid derivatives in an amount (e.g., a titer) of at least 10 mg/L, at least 25 mg/L, at least 100 mg/L, at least 200 mg/L, at least 500 mg/L, at least 1000 mg/L, or at least 2000 mg/L.

In various embodiments, the fatty acid derivative enzyme activity comprises a thioesterase activity, an ester synthase activity, a fatty aldehyde biosynthesis activity, a fatty alcohol biosynthesis activity, a ketone biosynthesis activity, and/or a hydrocarbon biosynthesis activity. In some embodiments, the recombinant microbial cell comprises polynucleotides encoding two or more polypeptides, each polypeptide having a fatty acid derivative enzyme activity. In more particular embodiments, the recombinant microbial cell expresses or overexpresses one or more polypeptides having fatty acid derivative enzyme activity selected from: (1) a polypeptide having thioesterase activity; (2) a polypeptide having decarboxylase activity; (3) a polypeptide having carboxylic acid reductase activity; (4) a polypeptide having alcohol dehydrogenase activity (EC 1.1.1.1); (5) a polypeptide having aldehyde decarbonylase activity (EC 4.1.99.5); (6) a polypeptide having acyl-CoA reductase activity (EC 1.2.1.50); (7) a polypeptide having acyl-ACP reductase activity; (8) a polypeptide having ester synthase activity (EC 3.1.1.67); (9) a polypeptide having OleA activity; or (10) a polypeptide having OleCD or OleBCD activity; wherein the recombinant microbial cell produces a composition comprising branched fatty acids, branched fatty esters, branched wax esters, branched fatty aldehydes, branched fatty alcohols, branched alkanes, branched alkenes, branched internal olefins, branched terminal olefins, or branched ketones.

In some embodiments, the fatty acid derivative composition produced by the recombinant cell comprises branched fatty acid derivatives, wherein at least 10%, at least 20%, at least 30%, at least 40%, at least 50%, at least 60%, at least 70%, at least 80% or at least 90% by weight of the fatty acid derivatives in the composition are branched fatty acid derivatives. In some embodiments, the fatty acid derivative composition comprises branched fatty acid derivatives in an amount (e.g., a titer) of at least 10 mg/L, at least 25 mg/L, at least 100 mg/L, at least 200 mg/L, at least 500 mg/L, at least 1000 mg/L, or at least 2000 mg/L. In some embodiments, the fatty acid derivative composition produced by the recombinant microbial cell culture comprises iso-branched fatty acid derivatives, wherein at least 10%, at least 20%, at least 30%, at least 40%, at least 50%, at least 60%, at least 70%, or at least 80% by weight of the branched fatty acid derivatives in the composition are iso-branched fatty acid derivatives.

In a fourth aspect, the invention includes a method of making a composition comprising an anteiso-branched fatty acid derivative, the method comprising: obtaining a recombinant microbial cell (such as, a culture comprising a recombinant microbial cell) comprising: (a) polynucleotides encoding a branched chain alpha-keto acid dehydrogenase (BKD) complex, comprising polypeptides having branched-chain alpha-keto acid dehydrogenase activity, lipoamide acyltransferase activity, and dihydrolipoamide dehydrogenase activity, and (b) a polynucleotide encoding a polypeptide having beta-ketoacyl-ACP synthase activity that utilizes a branched acyl-CoA molecule as a substrate, and comprising (c) polynucleotides encoding polypeptides having aspartokinase activity, homoserine dehydrogenase activity, homoserine kinase activity, threonine synthase activity, and threonine deaminase activity, or (d) polynucleotides encoding polypeptides having (R)-citramalate synthase activity, isopropylmalate isomerase activity, and beta-isopropyl malate dehydrogenase activity, or (c) and (d); and (e) polypeptides having acetohydroxyacid synthase activity, acetohydroxyacid isomeroreductase activity, and dihydroxy acid dehydratase activity; wherein at least one polynucleotide according to (a), (b), (c), (d), or (e) encodes a polypeptide that is exogenous to the recombinant microbial cell or expression of said polynucleotide is modulated in the recombinant microbial cell; the recombinant microbial cell further comprising one or more polynucleotides each which encodes a polypeptide having fatty acid derivative enzyme activity, wherein the recombinant microbial cell produces an anteiso-branched chain fatty acid derivative when cultured in the presence of a carbon source under conditions effective to express the polynucleotides; culturing the recombinant microbial cell in a culture medium containing a carbon source under conditions effective to express the polynucleotides and produce a fatty acid derivative composition comprising straight-chain fatty acid derivatives and branched fatty acid derivatives, the branched fatty acid derivatives comprising anteiso-branched fatty acid derivatives and iso-branched fatty acid derivatives; and optionally recovering the composition from the culture medium.

In various embodiments, the fatty acid derivative enzyme activity comprises a thioesterase activity, an ester synthase activity, a fatty aldehyde biosynthesis activity, a fatty alcohol biosynthesis activity, a ketone biosynthesis activity and/or a hydrocarbon biosynthesis activity, as described hereinabove; wherein the recombinant microbial cell produces a composition comprising anteiso-branched fatty acids, anteiso-branched fatty esters, anteiso-branched wax esters, anteiso-branched fatty aldehydes, anteiso-branched fatty alcohols, anteiso-branched alkanes, anteiso-branched alkenes, anteiso-branched terminal olefins, or anteiso-branched ketones.

In some embodiments, the fatty acid derivative composition produced by the recombinant cell comprises branched fatty acid derivatives, wherein at least 10%, at least 20%, at least 30%, at least 40%, at least 50%, at least 60%, at least 70%, at least 80% or at least 90% by weight of the fatty acid derivatives in the composition are branched fatty acid derivatives. In some embodiments, the fatty acid derivative composition comprises branched fatty acid derivatives in an amount (e.g., a titer) of at least 10 mg/L, at least 25 mg/L, at least 100 mg/L, at least 200 mg/L, at least 500 mg/L, at least 1000 mg/L, or at least 2000 mg/L. In some embodiments, the fatty acid derivative composition produced by the recombinant microbial cell culture comprises anteiso-branched fatty acid derivatives, wherein at least 10%, at least 20%, at least 30%, at least 40%, at least 50%, at least 60%, at least 70%, or at least 80% by weight of the branched fatty acid derivatives in the composition are anteiso-branched fatty acid derivatives. In some embodiments, the fatty acid derivative composition comprises anteiso-branched fatty acid derivatives in an amount (e.g., a titer) of at least 10 mg/L, at least 25 mg/L, at least 100 mg/L, at least 200 mg/L, at least 500 mg/L, at least 1000 mg/L, or at least 2000 mg/L.

These and other objects and features of the invention will become more fully apparent when the following detailed description is read in conjunction with the accompanying figures.

BRIEF DESCRIPTION OF THE DRAWINGS

FIGS. 2A and 2B depict exemplary intermediates and products of the BCFA biosynthetic pathway when supplied with the branched acyl-CoA molecules (A) 2-methyl-butyryl-CoA, which generates the anteiso-branched β-ketoacyl-ACP intermediate 4-methyl-3-oxo-hexanoyl-ACP, leading to production of anteiso-branched fatty acid derivatives, and (B) isobutyryl-CoA, which generates the iso-branched β-ketoacyl-ACP intermediate 4-methyl-3-oxo-pentanoyl-ACP, leading to production of iso-branched fatty acid derivatives. Likewise, the branched acyl-CoA molecule isovaleryl-CoA can produce iso-branched fatty acid derivatives via the iso-branched β-ketoacyl-ACP intermediate 5-methyl-3-oxo-hexanoyl-ACP.

DETAILED DESCRIPTION

Figure 1:
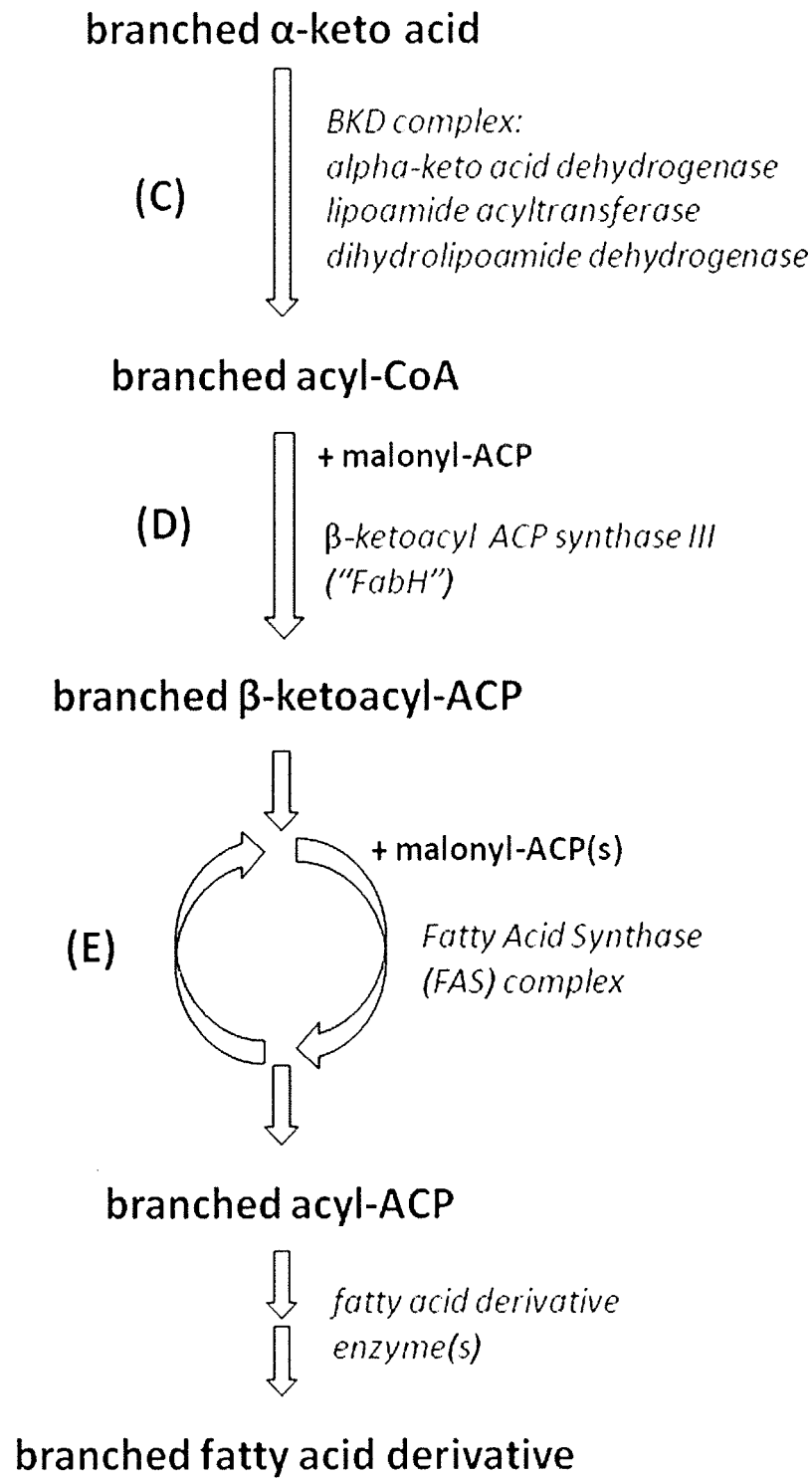
FIG. 1 depicts a branched chain fatty acid (BCFA) biosynthetic pathway as described herein.

The invention is not limited to the specific compositions and methodology described herein, as these may, of course, vary. It is also to be understood that the terminology used herein is for the purpose of describing particular embodiments only, and is not intended to limit the scope of the present invention.

Accession Numbers: Sequence Accession numbers throughout this description were obtained from databases provided by the NCBI (National Center for Biotechnology Information) maintained by the National Institute of Health, U.S.A. (which are identified herein as "NCBI Accession Numbers", or alternatively as "GenBank Accession Numbers"), and from the UniProt Knowledgebase (UniProtKB) and Swiss-Prot databases provided by the Swiss Institute of Bioinformatics (which are identified herein as "UniProtKB Accession Numbers"). Unless otherwise expressly indicated, the sequence identified by an NCBI/GenBank Accession number is version number 1 (that is, the Version Number of the sequence is "AccessionNumber.1"). The NCBI and UniProtKB accession numbers provided herein were those current as of Mar. 31, 2011.

Enzyme Classification (EC) Numbers: EC numbers are established by the Nomenclature Committee of the International Union of Biochemistry and Molecular Biology (IUBMB), description of which is available on the IUBMB Enzyme Nomenclature website on the WOrld Wide Web. EC numbers classify enzymes according to the reaction catalyzed. EC numbers referenced herein are derived from the KEGG Ligand database, maintained by the Kyoto Encyclopedia of Genes and Genomics, sponsored in part by the University of Tokyo. Unless otherwise indicated, EC numbers are as provided in the KEGG database as of Mar. 31, 2011.

Unless defined otherwise, all technical and scientific terms used herein have the same meaning as commonly understood to one of ordinary skill in the art to which this invention belongs. Although any materials and methods similar or equivalent to those described herein can be used in the practice or testing of the invention, the preferred compositions and methods are now described.

Definitions

As used herein, the term "fatty acid" means a carboxylic acid having the formula R(C=O)OH. R represents an aliphatic group, preferably an alkyl group, which can comprise between about 4 and about 22 carbon atoms. Fatty acids can be saturated, monounsaturated, or polyunsaturated. If unsaturated, R can have one or more points of unsaturation. R can be a straight chain or a branched chain. The branched chain may have one or more points of branching. The branched chain can have an iso- or anteiso-conformation.

The term "branched fatty acid" is synonymous with "branched chain fatty acid" and is abbreviated "BCFA" herein. Likewise, the term "branched fatty acid derivative" is synonymous with "branched chain fatty acid derivative" and is abbreviated herein "BCFA derivative". As used herein, the term "branched fatty aldehyde" is synonymous with "branched fatty acid aldehyde", "branched chain fatty aldehyde" and "branched chain fatty acid aldehyde"; the term "branched fatty alcohol" is synonymous with "branched fatty acid alcohol", "branched chain fatty alcohol" and "branched chain fatty acid alcohol"; the term "branched fatty ester" is synonymous with "branched fatty acid ester", "branched chain fatty ester" and "branched chain fatty acid ester"; and so on. As used herein, the term "branched hydrocarbon" is synonymous with "branched chain hydrocarbon", "branched alkane" is synonymous with "branched chain alkane", and so on.

As used herein, an "iso-" branched chain refers to a branched hydrocarbon structure having a methyl on the penultimate carbon atom, whereas an "anteiso-" branched chain refers to a branched hydrocarbon structure having a methyl on the third carbon atom from the end.

The term "branched 3-ketoacyl-ACP" as used herein refers to the product of the condensation of a branched acyl-CoA "primer" molecule with malonyl-ACP catalyzed by a beta ketoacyl-ACP synthase III (i.e., FabH) enzyme as represented by part (D) of the BCFA pathway in FIGS. 1, 2 and 3. This initial branched β-ketoacyl-ACP molecule enters the fatty acid synthase (FAS) cycle, represented by part (E) of FIG. 1, where it is subjected to a round of keto reduction, dehydration, and enoyl reduction, forming a branched acyl-ACP molecule which then condenses with another malonyl-ACP molecule followed by another cycle of keto reduction, dehydration, and enoyl reduction, elongating the acyl chain of the branched acyl-ACP by two carbon units per cycle. The "branched acyl-ACP" elongation product is an acyl thioester formed between the carbonyl carbon of a branched alkyl chain and the sulfydryl group of the 4'-phosphopantethionyl moiety of an acyl carrier protein (ACP) and, as used herein, typically has the formula R—C(O)S-ACP, wherein R is a branched alkyl group which may be in the "iso-" or the "anteiso-" configuration. The branched acyl-ACP is an intermediate in the production of branched chain fatty acids and branched chain fatty acid derivatives by the BCFA pathways described herein.

Unless otherwise specified, a "fatty acid derivative" is intended to include any product made at least in part by the fatty acid biosynthetic pathway of the recombinant microbial cell. A fatty acid derivative also includes any product made at least in part by a fatty acid pathway intermediate, such as an acyl-ACP intermediate. The fatty acid biosynthetic pathways described herein can include fatty acid pathway enzymes which can be engineered to produce fatty acid derivatives, and in some instances additional enzymes can be expressed to produce fatty acid derivatives having desired carbon chain characteristics, such as, for example, branched chain fatty acids and branched fatty acid derivatives (including, for example, anteiso-branched fatty acids and derivatives thereof) produced by enzymes of the branched chain fatty acid biosynthetic pathways described herein. Fatty acid derivatives include, but are not limited to, fatty acids, fatty aldehydes, fatty alcohols, fatty esters (such as waxes), hydrocarbons (such as alkanes and alkenes (e.g., terminal olefins and internal olefins)), and ketones.

Likewise, unless otherwise specified, a "branched fatty acid derivative" is intended to include any product made at least in part by a branched-chain fatty acid biosynthetic pathway (i.e., BCFA pathway) of a recombinant microbial cell described herein. A branched fatty acid derivative also includes any product made at least in part from a BCFA pathway intermediate, such as a branched acyl-ACP intermediate. Branched fatty acid derivatives include, but are not limited to, branched fatty acids, branched fatty aldehydes, branched fatty alcohols, branched fatty esters (such as waxes), branched hydrocarbons (such as branched alkanes and branched alkenes (e.g., branched terminal olefins and branched internal olefins)) and branched ketones.

An "endogenous" polypeptide (e.g., a polypeptide "endogenous" to a recombinant microbial cell), refers to a polypeptide encoded by the genome of the parental (i.e., host) cell from which the recombinant cell is engineered.

A "exogenous" polypeptide refers to a polypeptide which is not encoded by the genome of the parental microbial cell. A variant (i.e., mutant) polypeptide is an example of an exogenous polypeptide.

In embodiments of the invention wherein the recombinant polynucleotide sequence encodes an endogenous polypeptide, in some instances the endogenous polypeptide is overexpressed. Overexpression can be achieved by any suitable means. As used herein, "overexpress" means to express or cause to be expressed a polynucleotide or a polypeptide in a cell at a greater concentration than is normally expressed in a corresponding host (for example, wild-type) cell under the same conditions. For example, a polynucleotide can be "overexpressed" in a recombinant microbial cell when the polynucleotide is present in a greater concentration in the recombinant microbial cell as compared to its concentration in a non-recombinant microbial cell of the same species under the same conditions.

The term "increasing the level of expression of an endogenous polypeptide" means to cause the overexpression of a polynucleotide sequence encoding the endogenous polypeptide, or to cause the overexpression of an endogenous polypeptide sequence. The degree of overexpression can be about 1.5-fold or more, about 2-fold or more, about 3-fold or more, about 5-fold or more, about 10-fold or more, about 20-fold or more, about 50-fold or more, about 100-fold or more, or any range therein.

The term "increasing the level of activity of an endogenous polypeptide" means to enhance the biochemical or biological function (e.g., enzymatic activity) of an endogenous polypeptide. The degree of enhanced activity can be about 10% or more, about 20% or more, about 50% or more, about 75% or more, about 100% or more, about 200% or more, about 500% or more, about 1000% or more, or any range therein.

In some embodiments, overexpression of the endogenous polypeptide in the recombinant microbial cell is achieved by the use of an exogenous regulatory element. The term "exogenous regulatory element" generally refers to a regulatory element (such as, an expression control sequence or a chemical compound) originating outside of the host cell. However, in certain embodiments, the term "exogenous regulatory element" (e.g., "exogenous promoter") can refer to a regulatory element derived from the host cell whose function is replicated or usurped for the purpose of controlling the expression of the endogenous polypeptide in the recombinant cell. For example, if the host cell is an *E. coli* cell, and the polypeptide is an endogenous polypeptide, then expression of the endogenous polypeptide the recombinant cell can be controlled by a promoter derived from another *E. coli* gene. In some embodiments, the exogenous regulatory element that causes an increase in the level of expression and/or activity of an endogenous polypeptide is a chemical compound, such as a small molecule.

In some embodiments, the exogenous regulatory element which controls the expression of a polynucleotide (e.g., an endogenous polynucleotide) encoding an endogenous polypeptide is an expression control sequence which is operably linked to the endogenous polynucleotide by recombinant integration into the genome of the host cell. In certain embodiments, the expression control sequence is integrated into a host cell chromosome by homologous recombination using methods known in the art (e.g., Datsenko et al., *Proc. Natl. Acad. Sci. U.S.A.,* 97(12): 6640-6645 (2000)).

Expression control sequences are known in the art and include, for example, promoters, enhancers, polyadenylation signals, transcription terminators, internal ribosome entry sites (IRES), and the like, that provide for the expression of the polynucleotide sequence in a host cell. Expression control sequences interact specifically with cellular proteins involved in transcription (Maniatis et al., *Science,* 236: 1237-1245 (1987)). Exemplary expression control sequences are described in, for example, Goeddel, *Gene Expression Technology Methods in Enzymology,* Vol. 185, Academic Press, San Diego, Calif. (1990).

In the methods of the invention, an expression control sequence is operably linked to a polynucleotide sequence. By "operably linked" is meant that a polynucleotide sequence and expression control sequence(s) are connected in such a way as to permit gene expression when the appropriate molecules (e.g., transcriptional activator proteins) are bound to the expression control sequence(s). Operably linked promoters are located upstream of the selected polynucleotide sequence in terms of the direction of transcription and translation. Operably linked enhancers can be located upstream, within, or downstream of the selected polynucleotide. Additional nucleic acid sequences, such as nucleic acid sequences encoding selection markers, purification moieties, targeting proteins, and the like, can be operatively linked to the polynucleotide sequence, such that the additional nucleic acid sequences are expressed together with the polynucleotide sequence.

In some embodiments, the polynucleotide sequence is provided to the recombinant cell by way of a recombinant vector, which comprises a promoter operably linked to the polynucleotide sequence. In certain embodiments, the promoter is a developmentally-regulated, an organelle-specific, a tissue-specific, an inducible, a constitutive, or a cell-specific promoter.

As used herein, the term "vector" refers to a nucleic acid molecule capable of transporting another nucleic acid, i.e., a polynucleotide sequence, to which it has been linked. One type of useful vector is an episome (i.e., a nucleic acid capable of extra-chromosomal replication). Useful vectors are those capable of autonomous replication and/or expression of nucleic acids to which they are linked. Vectors capable of directing the expression of genes to which they are operatively linked are referred to herein as "expression vectors." In general, expression vectors of utility in recombinant DNA techniques are often in the form of "plasmids," which refer generally to circular double stranded DNA loops that, in their vector form, are not bound to the chromosome. The terms "plasmid" and "vector" are used interchangeably herein, inasmuch as a plasmid is the most commonly used form of vector. However, also included are such other forms of expression vectors that serve equivalent functions and that become known in the art subsequently hereto.

In some embodiments, the recombinant vector comprises at least one sequence selected from the group consisting of (a) an expression control sequence operatively linked to the polynucleotide sequence; (b) a selection marker operatively linked to the polynucleotide sequence; (c) a marker sequence operatively linked to the polynucleotide sequence; (d) a purification moiety operatively linked to the polynucleotide sequence; (e) a secretion sequence operatively linked to the polynucleotide sequence; and (f) a targeting sequence operatively linked to the polynucleotide sequence.

The expression vectors described herein include a polynucleotide sequence described herein in a form suitable for expression of the polynucleotide sequence in a host cell. It will be appreciated by those skilled in the art that the design of the expression vector can depend on such factors as the choice of the host cell to be transformed, the level of expression of polypeptide desired, etc. The expression vectors described herein can be introduced into host cells to produce polypeptides, including fusion polypeptides, encoded by the polynucleotide sequences as described herein.

Expression of genes encoding polypeptides in prokaryotes, for example, *E. coli*, is often carried out with vectors containing constitutive or inducible promoters directing the expression of either fusion or non-fusion polypeptides. Fusion vectors add a number of amino acids to a polypeptide encoded therein, usually to the amino- or carboxy-terminus of the recombinant polypeptide. Such fusion vectors typically serve one or more of the following three purposes: (1) to increase expression of the recombinant polypeptide; (2) to increase the solubility of the recombinant polypeptide; and (3) to aid in the purification of the recombinant polypeptide by acting as a ligand in affinity purification. Often, in fusion expression vectors, a proteolytic cleavage site is introduced at the junction of the fusion moiety and the recombinant polypeptide. This enables separation of the recombinant polypeptide from the fusion moiety after purification of the fusion polypeptide. Examples of such enzymes, and their cognate recognition sequences, include Factor Xa, thrombin, and enterokinase. Exemplary fusion expression vectors include pGEX (Pharmacia Biotech, Inc., Piscataway, N.J.; Smith et al., *Gene*, 67: 31-40 (1988)), pMAL (New England Biolabs, Beverly, Mass.), and pRITS (Pharmacia Biotech, Inc., Piscataway, N.J.), which fuse glutathione S-transferase (GST), maltose E binding protein, or protein A, respectively, to the target recombinant polypeptide.

Vectors can be introduced into prokaryotic or eukaryotic cells via conventional transformation or transfection techniques. As used herein, the terms "transformation" and "transfection" refer to a variety of art-recognized techniques for introducing foreign nucleic acid (e.g., DNA) into a host cell, including calcium phosphate or calcium chloride co-precipitation, DEAE-dextran-mediated transfection, lipofection, or electroporation. Suitable methods for transforming or transfecting host cells can be found in, for example, Sambrook et al. (supra).

For stable transformation of bacterial cells, it is known that, depending upon the expression vector and transformation technique used, only a small fraction of cells will take-up and replicate the expression vector. In order to identify and select these transformants, a gene that encodes a selectable marker (e.g., resistance to an antibiotic) can be introduced into the host cells along with the gene of interest. Selectable markers include those that confer resistance to drugs such as, but not limited to, ampicillin, kanamycin, chloramphenicol, or tetracycline. Nucleic acids encoding a selectable marker can be introduced into a host cell on the same vector as that encoding a polypeptide described herein or can be introduced on a separate vector. Host cells which are stably transformed with the introduced nucleic acid, resulting in recombinant cells, can be identified by growth in the presence of an appropriate selection drug.

Similarly, for stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., resistance to an antibiotic) can be introduced into the host cells along with the gene of interest. Preferred selectable markers include those which confer resistance to drugs, such as G418, hygromycin, and methotrexate. Nucleic acids encoding a selectable marker can be introduced into a host cell on the same vector as that encoding a polypeptide described herein or can be introduced on a separate vector. Host cells stably transfected with the introduced nucleic acid, resulting in recombinant cells, can be identified by growth in the presence of an appropriate selection drug.

"Gene knockout", as used herein, refers to a procedure by which a gene encoding a target protein is modified or inactivated so to reduce or eliminate the function of the intact protein. Inactivation of the gene may be performed by general methods such as mutagenesis by UV irradiation or treatment with N-methyl-N'-nitro-N-nitrosoguanidine, site-directed mutagenesis, homologous recombination, insertion-deletion mutagenesis, or "Red-driven integration" (Datsenko et al., *Proc. Natl. Acad. Sci. USA*, 97:6640-45, 2000). For example, in one embodiment, a construct is introduced into a parental cell, such that it is possible to select for homologous recombination events in the resulting recombinant cell. One of skill in the art can readily design a knock-out construct including both positive and negative selection genes for efficiently selecting transfected (i.e., recombinant) cells that undergo a homologous recombination event with the construct. The alteration in the parental cell may be obtained, for example, by replacing through a single or double crossover recombination a wild type (i.e., endogenous) DNA sequence by a DNA sequence containing the alteration. For convenient selection of transformants (i.e., recombinant cells), the alteration may, for example, be a DNA sequence encoding an antibiotic resistance marker or a gene complementing a possible auxotrophy of the host cell. Mutations include, but are not limited to, deletion-insertion mutations. An example of such an alteration in a recombinant cell includes a gene disruption, i.e., a perturbation of a gene such that the product that is normally produced from this gene is not produced in a functional form. This could be due to a complete deletion, a deletion and insertion of a selective marker, an insertion of a selective marker, a frameshift mutation, an in-frame deletion, or a point mutation that leads to premature termination. In some instances, the entire mRNA for the gene is absent. In other situations, the amount of mRNA produced varies.

The term, "the expression of said polynucleotide sequence is modified relative to the wild type polynucleotide sequence", as used herein means an increase or decrease in the level of expression and/or activity of an endogenous polynucleotide sequence. In some embodiments, an exogenous regulatory element which controls the expression of an endogenous polynucleotide is an expression control sequence which is operably linked to the endogenous polynucleotide by recombinant integration into the genome of the host cell. In some embodiments, the expression control sequence is integrated into a host cell chromosome by homologous recombination using methods known in the art.

As used herein, the term "under conditions effective to express said polynucleotide sequences" means any conditions that allow a recombinant cell to produce a desired fatty acid derivative. Suitable conditions include, for example, fermentation conditions. Fermentation conditions can comprise many parameters, such as temperature ranges, levels of aeration, and media composition. Each of these conditions, individually and in combination, allows the host cell to grow. Exemplary culture media include broths or gels. Generally, the medium includes a carbon source that can be metabolized by a recombinant cell directly. Fermentation denotes the use of a carbon source by a production host, such as a recombinant microbial cell of the invention. Fermentation can be aerobic, anaerobic, or variations thereof (such as micro-aerobic). As will be appreciated by those of skill in the art, the conditions under which a recombinant microbial cell can process a carbon source into a branched acyl-ACP or a desired branched fatty acid derivative (e.g., a branched fatty acid, branched fatty ester, branched fatty aldehyde, branched fatty alcohol, branched alkane, or branched olefin) will vary in part, based upon the specific microorganism. In some embodiments, the process occurs in an aerobic environment. In some embodiments, the process occurs in an anaerobic environment. In some embodiments, the process occurs in a micro-aerobic environment.

As used herein, the phrase "carbon source" refers to a substrate or compound suitable to be used as a source of carbon for prokaryotic or simple eukaryotic cell growth. Carbon sources can be in various forms, including, but not limited to polymers, carbohydrates, acids, alcohols, aldehydes, ketones, amino acids, peptides, and gases (e.g., CO and $CO_2$). Exemplary carbon sources include, but are not limited to, monosaccharides, such as glucose, fructose, mannose, galactose, xylose, and arabinose; oligosaccharides, such as fructo-oligosaccharide and galacto-oligosaccharide; polysaccharides such as starch, cellulose, pectin, and xylan; disaccharides, such as sucrose, maltose, cellobiose, and turanose; cellulosic material and variants such as hemicelluloses, methyl cellulose and sodium carboxymethyl cellulose; saturated or unsaturated fatty acids, succinate, lactate, and acetate; alcohols, such as ethanol, methanol, and glycerol, or mixtures thereof. The carbon source can be a branched short-chain carboxylic acid such as isobutyrate, isovalerate, or 2-methyl-butyrate. The carbon source can be a product of photosynthesis, such as glucose. In certain preferred embodiments, the carbon source is biomass. In another preferred embodiment, the carbon source comprises sucrose. In another preferred embodiment, the carbon source comprises glucose.

As used herein, the term "biomass" refers to any biological material from which a carbon source is derived. In some embodiments, a biomass is processed into a carbon source, which is suitable for bioconversion. In other embodiments, the biomass does not require further processing into a carbon source. The carbon source can be converted into a biofuel. An exemplary source of biomass is plant matter or vegetation, such as corn, sugar cane, or switchgrass. Another exemplary source of biomass is metabolic waste products, such as animal matter (e.g., cow manure). Further exemplary sources of biomass include algae and other marine plants. Biomass also includes waste products from industry, agriculture, forestry, and households, including, but not limited to, fermentation waste, ensilage, straw, lumber, sewage, garbage, cellulosic urban waste, and food leftovers. The term "biomass" also can refer to sources of carbon, such as carbohydrates (e.g., monosaccharides, disaccharides, or polysaccharides).

To determine if conditions are sufficient to allow production of a product or expression of a polypeptide, a recombinant microbial cell can be cultured, for example, for about 4, 8, 12, 24, 36, 48, 72, or more hours. During and/or after culturing, samples can be obtained and analyzed to determine if the conditions allow production or expression. For example, the recombinant microbial cells in the sample or the medium in which the recombinant microbial cells were grown can be tested for the presence of a desired product. When testing for the presence of a branched fatty acid, a branched fatty ester, a branched fatty aldehyde, a branched fatty alcohol, a branched hydrocarbon or other branched fatty acid derivative, assays, such as, but not limited to, gas chromatography (GC), mass spectroscopy (MS), thin layer chromatography (TLC), high-performance liquid chromatography (HPLC), liquid chromatography (LC), GC coupled with a flame ionization detector (FID), GC-MS, and LC-MS can be used. When testing for the expression of a polypeptide, techniques such as, but not limited to, Western blotting and dot blotting may be used.

As used herein, the term "microorganism" means prokaryotic and eukaryotic microbial species from the domains Archaea, Bacteria and Eucarya, the latter including yeast and filamentous fungi, protozoa, algae, and higher Protista. The terms "microbes" and "microbial cells" (i.e., cells from microbes) and are used interchangeably with "microorganisms" and refer to cells or small organisms that can only be seen with the aid of a microscope.

In some embodiments, the host cell is a microbial cell. In some embodiments, the host cell is selected from the genus *Escherichia, Bacillus, Lactobacillus, Pantoea, Zymomonas, Rhodococcus, Pseudomonas, Aspergillus, Trichoderma, Neurospora, Fusarium, Humicola, Rhizomucor, Kluyveromyces, Pichia, Mucor, Myceliophtora, Penicillium, Phanerochaete, Pleurotus, Trametes, Chrysosporium, Saccharomyces, Stenotrophamonas, Schizosaccharomyces, Yarrowia, Streptomyces, Synechococcus, Chlorella*, or *Prototheca*.

In other embodiments, the host cell is a *Bacillus lentus* cell, a *Bacillus brevis* cell, a *Bacillus stearothermophilus* cell, a *Bacillus lichenoformis* cell, a *Bacillus alkalophilus* cell, a *Bacillus coagulans* cell, a *Bacillus circulans* cell, a *Bacillus pumilis* cell, a *Bacillus thuringiensis* cell, a *Bacillus clausii* cell, a *Bacillus megaterium* cell, a *Bacillus subtilis* cell, or a *Bacillus amyloliquefaciens* cell.

In other embodiments, the host cell is a *Trichoderma koningii* cell, a *Trichoderma viride* cell, a *Trichoderma reesei* cell, a *Trichoderma longibrachiatum* cell, an *Aspergillus awamori* cell, an *Aspergillus fumigates* cell, an *Aspergillus foetidus* cell, an *Aspergillus nidulans* cell, an *Aspergillus niger* cell, an *Aspergillus oryzae* cell, a *Humicola insolens* cell, a *Humicola lanuginose* cell, a *Rhodococcus opacus* cell, a *Rhizomucor miehei* cell, or a *Mucor michei* cell.

In yet other embodiments, the host cell is a *Streptomyces lividans* cell or a *Streptomyces murinus* cell.

In yet other embodiments, the host cell is an *Actinomycetes* cell.

In some embodiments, the host cell is a *Saccharomyces cerevisiae* cell.

In still other embodiments, the host cell is a CHO cell, a COS cell, a VERO cell, a BHK cell, a HeLa cell, a Cvl cell, an MDCK cell, a 293 cell, a 3T3 cell, or a PC12 cell.

In some embodiments, the host cell is a cell from an eukaryotic plant, algae, cyanobacterium, green-sulfur bacterium, green non-sulfur bacterium, purple sulfur bacterium, purple non-sulfur bacterium, extremophile, yeast, fungus, an engineered organism thereof, or a synthetic organism. In some embodiments, the host cell is light-dependent or fixes carbon. In some embodiments, the host cell has autotrophic activity. In some embodiments, the host cell has photoautotrophic activity, such as in the presence of light. In some embodiments, the host cell is heterotrophic or mixotrophic in the absence of light.

In certain embodiments, the host cell is a cell from *Avabidopsis thaliana, Panicum virgatum, Miscanthus giganteus, Zea mays, Botryococcuse braunii, Chlamydomonas reinhardtii, Dunaliela salina, Synechococcus* Sp. PCC 7002, *Synechococcus* Sp. PCC 7942, *Synechocystis* Sp. PCC 6803, *Thermosynechococcus elongates* BP-1, *Chlorobium tepidum, Chlorojlexus auranticus, Chromatiumm vinosum, Rhodospirillum rubrum, Rhodobacter capsulatus, Rhodopseudomonas palusris, Clostridium ljungdahlii, Clostridiuthermocellum, Penicillium chrysogenum, Pichia pastoris, Saccharomyces cerevisiae, Schizosaccharomyces pombe, Pseudomonas jluorescens, Pantoea citrea* or

*Zymomonas mobilis*. In certain embodiments, the host cell is a cell from *Chlorella fusca, Chlorella protothecoides, Chlorella pyrenoidosa, Chlorella kessleri, Chlorella vulgaris, Chlorella saccharophila, Chlorella sorokiniana, Chlorella ellipsoidea, Prototheca stagnora, Prototheca portoricensis, Prototheca moriformis, Prototheca wickerhamii,* or *Prototheca zopfii*.

In some embodiments, the host cell is a Gram-positive bacterial cell. In other embodiments, the host cell is a Gram-negative bacterial cell.

In certain preferred embodiments, the host cell is an *E. coli* cell. In some embodiments, the *E. coli* cell is a strain B, a strain C, a strain K, or a strain W *E. coli* cell.

In certain embodiments of the invention, the host cell is engineered to express (or overexpress) a transport protein. Transport proteins can export polypeptides and organic compounds (e.g., fatty acids or derivatives thereof) out of a host cell.

As used herein, the term "metabolically engineered" or "metabolic engineering" involves rational pathway design and assembly of polynucleotides corresponding to biosynthetic genes, genes associated with operons, and control elements of such polynucleotides, for the production of a desired metabolite, such as, for example, a branched α-keto acid, a branched β-ketoacyl-ACP, a branched acyl-ACP, or a branched fatty acid derivative, in a recombinant cell, such as, a recombinant microbial cell. "Metabolically engineered" can further include optimization of metabolic flux by regulation and optimization of transcription, translation, protein stability and protein functionality using genetic engineering and appropriate culture conditions including the reduction of, disruption, or knocking out of, a competing metabolic pathway that competes with an intermediate leading to a desired pathway. A "biosynthetic gene" can be native to the host cell (i.e., a gene which is not modified from the host cell), or, can be exogenous (heterologous) to the host cell either by virtue of being foreign to the host cell, or by being modified by mutagenesis, recombination, and/or association in the recombinant cell with a exogenous (heterologous) expression control sequence. A biosynthetic gene encodes a "biosynthetic polypeptide" or a "biosynthetic enzyme".

The term "biosynthetic pathway", also referred to as "metabolic pathway", refers to a set of biochemical reactions, catalyzed by biosynthetic enzymes, which convert one chemical species into another. As used herein, the term "fatty acid biosynthetic pathway" (or more simply, "fatty acid pathway") refers to a set of biochemical reactions that produces fatty acid derivatives (e.g., fatty acids, fatty esters, fatty aldehydes, fatty alcohols, alkanes, alkenes, ketones, and so forth). The fatty acid pathway includes fatty acid pathway biosynthetic enzymes (i.e., "fatty acid pathway enzymes") that can be engineered, as described herein, to produce fatty acid derivatives, and in some embodiments can be expressed with additional enzymes to produce fatty acid derivatives having desired carbon chain characteristics. For example, a "branched chain fatty acid biosynthetic pathway" (i.e., a "BCFA pathway") as described herein includes enzymes sufficient to produce branched fatty acid derivatives.

The term "recombinant microbial cell" refers to a microbial cell (i.e., a microorganism) that has been genetically modified (i.e., "engineered") by the introduction of genetic material into a "parental microbial cell" (i.e., a host cell) of choice, thereby modifying or altering the cellular physiology and biochemistry of the parental cell. Through the introduction of genetic material, the recombinant microbial cell acquires a new or improved property compared to that of the parental microbial cell, such as, for example, the ability to produce a new, or greater quantities of, an intracellular metabolite. Recombinant microbial cells provided herein can express a plurality of biosynthetic enzymes (e.g., fatty acid pathway enzymes, such as BCFA pathway enzymes) involved in pathways for the production of, e.g., a branched acyl-CoA, a branched acyl-ACP, or a branched fatty acid derivative (such as a branched fatty acid, branched fatty ester, branched wax ester, branched fatty aldehyde, branched fatty alcohol, branched alkane, branched alkene, branched terminal olefin, branched internal olefin, or branched ketone), from a suitable carbon source. The genetic material introduced into the parental microbial cell contains gene(s), or parts of genes, coding for one or more of the enzymes involved in a biosynthetic pathway (that is, biosynthetic enzymes) for the production of a branched fatty acid derivative, and may also include additional elements for the expression and/or regulation of expression of these genes, such as promoter sequences. Accordingly, recombinant microbial cells described herein have been genetically engineered to express or overexpress biosynthetic enzymes involved in branched chain fatty acid (BCFA) biosynthetic pathways as described herein.

It is understood that the terms "recombinant microbial cell" and "recombinant microorganism" refer not only to the particular recombinant microbial cell/microorganism, but to the progeny or potential progeny of such a microbial cell.

A recombinant microbial cell can, alternatively or in addition to comprising genetic material introduced into the parental microbial cell, include a reduction, disruption, deletion or a "knocking-out" of a gene or polynucleotide to alter the cellular physiology and biochemistry of the parental microbial cell. Through the reduction, disruption, deletion or knocking-out of a gene or polynucleotide (also known as "attenuation" of the gene or polynucleotide), the recombinant microbial cell acquires a new or improved property (such as, for example, the ability to produce a new or greater quantities of an intracellular metabolite, the ability to improve the flux of a metabolite through a desired pathway, and/or the ability to reduce the production of an undesirable by-product) compared to that of the parental microbial cell.

Engineering Recombinant Microbial Cells to Produce Branched Fatty Acid Derivatives Branched chain fatty acids are normally produced in bacteria such as *Bacillus, Stenotrophomonas, Streptomyces, Listeria, Staphylococcus,* and *Streptococcus* (Kaneda, *Microbiol. Rev.* 55: 288-302 (1991). Branched acyl-CoA molecules are synthesized in such microorganisms by the action of a branched alpha-keto acid dehydrogenase (BKD) complex (Cropp et al., *Can J Microbiol* 46: 506-14 (2000)). BKD complexes also occur in microorganisms such as *Pseudomonas* that are capable of metabolizing branched-chain amino acids (leucine, isoleucine or valine) or branched-chain α-keto acids as carbon sources (Sokatch et al., *J. Bacteriol.* 148: 647-652 (1981)). Enzymes with beta-ketoacyl ACP synthase III activity (also termed "FabH") that utilize branched-CoA substrates then catalyze the initial condensation of the branched acyl-CoA with malonyl-ACP to form a branched β-keto acyl-ACP intermediate, which then enters the fatty acid synthase (FAS) cycle to elongate the branched acyl chains.

In nature, some bacteria do not produce branched chain fatty acids; for instance, native *E. coli* lacks components of a BKD complex, and the native *E. coli* beta-ketoacyl ACP synthase (FabH) enzyme only accepts straight-chain acyl-CoA molecules in the condensation with malonyl-ACP, producing straight-chain β-keto acyl-ACP intermediates and generating straight-chain fatty acids.

The invention is based in part on the discovery that by engineering microorganisms to introduce or to improve biosynthetic pathways involving the generation of branched chain alpha-keto acids and branched chain acyl-CoA intermediates from simple sugars, metabolic flux through branched chain pathway intermediates is created or is enhanced, and compositions of branched fatty acid products are optimized, resulting in efficient microbial production of branched chain fatty acids and branched chain fatty acid derivatives from simple sugars or biomass.

As the ultimate goal is to provide environmentally responsible and cost-effective methods for the production of branched chain fatty derivatives on an industrial scale starting from sugars (such as monosaccharides or disaccharides) or biomass, improvements in yield of microbially produced branched chain molecules, and optimization of the compositions of microbially produced branched chain molecules, such as by increasing the amount of anteiso-branched chain products relative to iso-branched chain products, is desirable. Accordingly, strategies for the overproduction of various pathway intermediates have been examined to increase the flux of metabolites through branched chain fatty acid biosynthetic pathways. Pathways that direct metabolic flux from a starting material, such as a sugar, to a branched acyl-CoA intermediate, to a branched acyl-ACP intermediate, and to a branched fatty acid product or branched fatty acid derivative product, can be engineered in an industrially useful microorganism.

In one aspect, the invention includes a recombinant microbial cell comprising polynucleotides encoding one or more enzymes which participate in the biosynthesis of a branched acyl-ACP intermediate when the microorganism is cultured in the presence of a carbon source under conditions effective to expresses the polynucleotides. In some embodiments, the recombinant microbial cell further comprises one or more polynucleotides each which encodes a polypeptide having a fatty acid derivative enzyme activity, wherein the recombinant microbial cell produces a branch fatty acid derivative when cultured in the presence of a carbon source under conditions sufficient to expresses the polynucleotides. The invention also includes methods of making branched fatty acid derivatives comprising culturing a recombinant microbial cell of the invention.

The recombinant microbial cell can be a filamentous fungi, an algae, a yeast, or a prokaryote such as a bacterium (e.g., an *E. coli* or a *Bacillus* sp).

In general, branched fatty acid derivatives (such as, branched fatty acids, branched fatty esters (including branched fatty acid methyl esters (branched-FAMEs), branched fatty acid ethyl esters (branched-FAEEs), and branched wax esters), branched fatty aldehydes, branched fatty alcohols, branched ketones, and branched hydrocarbons (including branched alkanes, branched alkenes, branched terminal olefins, branched internal olefins)) can be produced in a recombinant microbial cell of the invention via the branched fatty acid biosynthetic pathway ("BCFA pathway") depicted in FIG. 1.

To produce a branched fatty acid derivative, the recombinant microbial cell utilizes a branched acyl-CoA molecule as a "primer" for the initiation of the branched fatty acyl chain elongation process. The branched fatty acyl elongation process initially involves condensation of the branched acyl-CoA primer with a malonyl-ACP molecule, catalyzed by a β-ketoacyl ACP synthase III enzyme, to form a branched β-ketoacyl-ACP intermediate (as depicted in step (D) of FIG. 1). The branched β-ketoacyl-ACP intermediate undergoes keto-reduction, dehydration and enoyl-reduction at the β-carbon to form an initial branched acyl-ACP intermediate, which undergoes further cycles of condensation with malonyl-ACP, keto-reduction, dehydration, and enoyl-reduction to form branched acyl-ACP intermediates of increasing length. The elongated branched acyl-ACP intermediate is then converted to a branched fatty acid derivative (such as, a branched fatty acid, a branched fatty ester, a branched fatty aldehyde, a branched fatty alcohol, a branched hydrocarbon, or a branched ketone). This is in contrast to the process in, for example, wild-type *E. coli*, which produces straight-chain fatty acids but not branched chain fatty acids. In wild-type *E. coli*, the straight-chain primer molecule acetyl-CoA initially condenses with a malonyl-ACP molecule to form a straight-chain β-keto acyl-ACP intermediate, which likewise undergoes cycles of keto-reduction, dehydration, enoyl-reduction and condensation with additional malonyl-ACP molecules, to ultimately produce, e.g., a straight-chain fatty acid.

The above-noted branched acyl-CoA "primer" molecule can be supplied to the BCFA biosynthetic pathway of the recombinant microbial cell of the invention by a number of methods, as follows.

In one embodiment, a branched acyl-CoA molecule is generated by the native biosynthetic machinery of the microbial cell (e.g., is endogenous to the parental microbial cell). In some such instances, to increase the amount of the branched acyl-CoA molecule produced in the recombinant microbial cell, one or more enzymes endogenous to the parental microbial cell which contribute to the production of branched acyl-CoA (such as, for example, one or more components of a native BKD complex, corresponding to the step labeled (C) of the pathway in FIG. 1) can be overexpressed in the recombinant microbial cell.

In another embodiment, a branched acyl-CoA molecule is produced in the recombinant microbial cell by engineering the cell to express exogenous enzymes, such as one or more components of an exogenous BKD complex, which diverts metabolic flux through branched α-keto acid intermediates to produce branched acyl-CoA molecules, as represented by step (C) of FIG. 1. This approach is particularly useful in engineering microbial cells such as *E. coli* that do not ordinarily produce branched fatty acids. Polynucleotides encoding components of the BKD complex can be obtained from microorganisms that normally produce branched chain fatty acids or can metabolize branched-chain amino acids or branched α-ketoacids, including, but not limited to, strains of *Bacillus*, *Pseudomonas*, *Streptomyces*, *Listeria*, *Staphylococcus*, and *Streptococcus*.

A BKD complex comprises three components: an E1 component having α-keto acid dehydrogenase activity (e.g., EC 1.2.4.4), which, depending on the source, may be a single polypeptide (that is, a monomer), or, two different polypeptides (i.e., a heterodimer) denoted E1alpha and E1beta; an E2 component having lipoamide acyltransferase activity (e.g., EC 2.3.1.168), and a third component, denoted E3, having dihydrolipoamide dehydrogenase activity (e.g., EC 1.8.1.4). Both the E1 (or E1alpha/E1beta) and E2 components of the BKD complex utilize branched substrates. In some instances, an enzyme having dihydrolipoamide dehydrogenase activity (e.g., EC 1.8.1.4) that is endogenous to a microbial cell which does not normally produce branched fatty acids (such as *E. coli*) but which can nevertheless utilize branched chain substrates can be used instead of a BKD E3 component derived from a strain that normally produces branched chain fatty acids or metabolizes branched-chain amino acids or branched α-ketoacids.

In one embodiment, one or more polynucleotide sequences each encoding a polypeptide having a BKD activity (α-keto acid acid dehydrogenase activity, lipoamide acyltransferase activity, or dihydrolipoamide dehydrogenase activity) which is endogenous to the parental microbial cell is overexpressed in the recombinant microbial cell. In another embodiment, one or more polynucleotide sequences each encoding a polypeptide having a BKD activity (α-keto acid acid dehydrogenase activity, lipoamide acyltransferase activity, or dihydrolipoamide dehydrogenase activity) which is exogenous to the parental microbial cell is expressed or overexpressed in the recombinant microbial cell. Polynucleotide sequences encoding polypeptides having BKD activities (α-keto acid dehydrogenase activity, lipoamide acyltransferase activity, dihydrolipoamide dehydrogenase activity) can be obtained from a microorganism that normally produces branched chain fatty acids or can metabolize branched-chain amino acids or branched α-ketoacids (including, but not limited to, strains of *Bacillus, Pseudomonas, Streptomyces, Listeria, Staphylococcus*, and *Streptococcus*). In some embodiments, the polynucleotide sequence is modified to generate a variant polypeptide having a BDK activity and an improved property, compared to that of the parent polypeptide, which is more suited to the microbial cell and/or to the pathway being engineered; such as, for example, increased catalytic activity or improved stability under conditions in which the recombinant microbial cell is cultured; reduced inhibition (e.g., reduced feedback inhibition) by a cellular metabolite or by a culture media component, and the like. Non-limiting examples of BKD component polypeptides and nucleic acids encoding such polypeptides for use in engineering part (C) of the BCFA biosynthetic pathway are provided in Table 4, below.

In another embodiment, a branched acyl-CoA molecule is produced in the recombinant microbial cell by engineering the cell to express or overexpress certain transport/activation enzymes that participate in the conversion of a branched short-chain carboxylic acid substrate to the branched acyl-CoA molecule. The transport/activation enzymes can include, without limitation, a phosphotransbutyrylase (ligase) (e.g., EC 2.3.1.19) and/or a butyrate kinase (e.g., EC 2.7.2.7). In one embodiment, the recombinant microbial cell expresses a phosphotransbutyrylase (ligase) and a butyrate kinase from *Clostridium acetobutylicum*. The branched short-chain carboxylic acid substrate (such as isobutyrate, isovalerate, or 2-methyl-butyrate) is converted to the branched acyl-CoA molecule (such as, isobutyryl-CoA, isovaleryl-CoA, or 2-methyl-butyryl-CoA). In some instances, such a recombinant microbial cell is cultured in the presence of (i.e., is "fed") the branched short-chain carboxylic acid substrate, e.g., isobutyrate, isovalerate, or 2-methyl-butyrate, resulting in the production of isobutyryl-CoA, isovaleryl-CoA, or 2-methyl-butyryl-CoA, respectively.

In another embodiment, the branched acyl-CoA molecule isobutyryl-CoA is produced in the recombinant microbial cell by engineering the cell to express a crotonyl-CoA reductase (Ccr, EC 1.6.5.5, 1.1.1.1) and an isobutyryl-CoA mutase (large subunit IcmA, EC 5.4.99.2; small subunit IcmB, EC 5.4.99.2) (Han and Reynolds, *J. Bacteriol*. 179:5157, 1997). Non-limiting examples of ccr and icm genes include the ccr, icmA and icmB genes from *Streptomyces coelicolor* (e.g., NCBI Accession Numbers NP_630556, NP_629554, and NP_630904, respectively), and the ccr, icmA and icmB genes from *Streptomyces cinnamonensis* (e.g., NCBI accession numbers AAD53915, AAC08713, and AJ246005, respectively).

In another embodiment, a branched acyl-CoA molecule is produced in the recombinant microbial cell by engineering the cell to express enzymes that direct metabolic flux from simple starting materials (e.g., sugars, such as glucose) to generate branched α-keto acid intermediates, which are then acted upon by the native biosynthetic machinery of the particular recombinant microbial cell, or, by BKD complex components engineered in the recombinant microbial cell (for example, as described above), to generate branched acyl-CoA molecules. An example of this approach is described in more detail below and is outlined in FIG. 3A.

As noted above, the branched acyl-CoA molecule serves as a primer for branched acyl-chain elongation. Initiation of the elongation process involves condensation of the branched acyl-CoA with a malonyl-ACP molecule to form a branched β-ketoacyl-ACP intermediate. This step, as represented by part (D) of FIG. 1, is catalyzed in the recombinant microbial cell by an enzyme having β-ketoacyl-ACP synthase III activity (e.g., EC 2.3.1.180) which utilizes a branched acyl-CoA molecule as a substrate (in other words, an enzyme having "branched chain β-ketoacyl-ACP synthase III" activity). The enzyme can be endogenous to the recombinant microbial cell (for example, if the parental microbial cell normally produces branched chain fatty acids), or exogenous the recombinant microbial cell.

In one embodiment, a polynucleotide encoding a polypeptide endogenous to the parental microbial cell having branched chain β-ketoacyl-ACP synthase III activity is overexpressed in the recombinant microbial cell. In another embodiment, a polynucleotide encoding a polypeptide having branched chain β-ketoacyl-ACP synthase III activity which is exogenous to the parental microbial cell is expressed or overexpressed in the recombinant microbial cell. A polynucleotide sequence encoding a polypeptide having branched chain β-ketoacyl-ACP synthase III activity can be obtained from a microbial cell that normally produces branched chain fatty acids (including, but not limited to, strains of *Bacillus, Streptomyces, Listeria, Staphylococcus*, and *Streptococcus*). In some embodiments, the polynucleotide sequence is modified to generate a variant polypeptide having branched chain β-ketoacyl-ACP synthase III activity and an improved property, compared to that of the parent polypeptide, which is more suited to the microbial cell and/or to the pathway being engineered; such as, for example, increased catalytic activity or improved stability under conditions in which the recombinant microbial cell is cultured; reduced inhibition (e.g., reduced feedback inhibition) by a cellular metabolite or by a culture media component, and the like. Non-limiting examples of β-ketoacyl-ACP synthase III enzymes and genes encoding such enzymes for use in engineering part (D) of the branched fatty acid pathway are provided in Table 5, below.

One or more enzymes endogenous to the parental microbial cell may compete for substrate with enzymes of the engineered BCFA biosynthetic pathway in the recombinant microbial cell, or may break down or otherwise divert an intermediate in the BCFA biosynthetic pathway; genes encoding such undesired endogenous enzymes may be attenuated to increase the production of branched fatty acid derivatives by the recombinant microbial cell. For example, in *E. coli*, the endogenous β-ketoacyl-ACP synthase III (UniProtKB/Swiss-Prot Protein Accession Number P0A6R0), encoded by the *E. coli* fabH gene, primarily utilizes short straight-chain acyl-CoA molecules such as acetyl-CoA, but does not utilize branched acyl-CoA molecules, and thus competes with enzymes of the branched chain pathway for malonyl-ACP and other substrates and diverts metabolic flux away from the BCFA pathway. Deleting or otherwise reducing the expression of the *E. coli* fabH gene thus directs biosynthesis in recombinant *E. coli* away from straight-chain and more towards branched β-ketoacyl-ACP intermediates, and ultimately more towards branched-chain fatty acid production.

The branched β-ketoacyl-ACP intermediate generated in part (D) of the BCFA pathway (FIG. 1) can undergo elongation by successive cycles of keto-reduction, dehydration and enoyl-reduction at the beta carbon and further condensation with malonyl-ACP molecules catalyzed by a fatty acid synthase (FAS) complex, such as for example a Type II FAS complex, adding 2-carbon units to the lengthening chain of the branched acyl-ACP intermediate as represented by part (E) of FIG. 1. In one embodiment, an endogenous FAS complex native to the recombinant microbial cell catalyzes cycles of condensation with malonyl-ACP/keto-reduction/dehydration/enoyl-reduction to produce the branched acyl-ACP intermediate.

Branched fatty acid derivatives (such as branched fatty acids, branched fatty esters, branched fatty aldehydes, branched fatty alcohols, branched hydrocarbons, and branched ketones) can be produced from the branched acyl-ACP intermediate, as will be described in more detail below. Accordingly, in some embodiments, the recombinant microbial cell further comprises one or more polynucleotide sequences each encoding a polypeptide having fatty acid derivative enzyme activity, such as thioesterase (e.g., TesA), decarboxylase, carboxylic acid reductase (CAR; e.g., CarB), alcohol dehydrogenase/aldehyde reductase; aldehyde decarbonylase, fatty alcohol forming acyl-CoA reductase (FAR), acyl ACP reductase (AAR), ester synthase, or acyl-CoA reductase (ACR1), OleA, OleCD, or OleBCD, wherein the microbial cell produces a composition comprising a branched fatty acid, a branched fatty ester (such as a branched fatty methyl ester, branched fatty ethyl ester, a branched wax ester), a branched fatty aldehyde, a branched fatty alcohol, a branched hydrocarbon (such as a branched alkane, a branched terminal olefin, or a branched internal olefin), or a branched ketone, when the microbial cell is cultured in the presence of a carbon source under conditions effective to expresses the polynucleotides. The invention also includes methods for the production of a branched fatty acid derivative comprising culturing a recombinant microbial cell of the invention.

Engineering Recombinant Microbial Cells to Produce Anteiso-Branched or Iso-Branched Fatty Acid Derivatives The branching of the fatty acid derivative molecules can occur in the iso-configuration or the anteiso-configuration. Branched chain fatty acids and their derivatives, particularly in the anteiso-configuration, are preferred components of fuel compositions, due to lower melting points and higher oxidative stabilities compared to the non-branched (i.e., straight-chain) compounds.

To preferentially produce a particular branched fatty acid derivative, such as, an anteiso-branched fatty acid derivative or an iso-branched fatty acid derivative, the recombinant microbial cell can be modified to generate a particular branched acyl-CoA molecule, which serves as a primer for the initiation of chain elongation. The structure of the branched acyl-CoA primer molecule in part determines the structure of the final product.

For example, condensation of the branched acyl-CoA molecule 2-methyl-butyryl-CoA with malonyl-ACP catalyzed by a branched chain β-ketoacyl-ACP synthase III generates the anteiso-branched β-ketoacyl-ACP intermediate 4-methyl-3-oxo-hexanoyl-ACP, leading to production of anteiso-branched acyl-ACP intermediates and ultimately anteiso-branched fatty acid derivatives (FIG. 2A). On the other hand, condensation of isobutyryl-CoA or isovaleryl-CoA with malonyl-ACP generates the iso-branched β-ketoacyl-ACP intermediates 4-methyl-3-oxo-pentanoyl-ACP or 5-methyl-3-oxo-hexanoyl-ACP, respectively, leading to production of iso-branched acyl-ACP intermediates and ultimately iso-branched fatty acid derivatives (FIG. 2B).

Manipulation of various amino acid biosynthetic pathways has been shown to increase the production of those amino acids in microbial cells (Guillouet S., et al., *Appl. Environ. Microbiol.* 65:3100-3107 (1999); Lee K. H., et al., *Mol. Syst. Biol.* 3:149 (2007)). Amino acid biosynthetic pathways have been used in the production of short chain branched alcohols in *E. coli* (Atsumi S. and Liao J. C., *Appl. Environ. Microbiol.* 74(24): 7802-7808 (2008); Cann A. F. and Liao J. C., *Appl Microbiol Biotechnol.* 81(1):89-98 (2008); Zhang K., et al., *Proc. Natl. Acad. Sci. USA.* 105(52):20653-20658 (2008)). The present invention is based in part on the discovery that directing the flux of certain amino acid biosynthetic metabolites to the production of branched α-keto acid intermediates, and diverting those branched α-keto acid intermediates to conversion into branched acyl-CoAs and entry into the fatty acid biosynthetic pathway optimizes the structures and improve the yields of branched chain fatty acid products.

Accordingly, in one aspect, the invention includes a recombinant microbial cell comprising polynucleotides encoding one or more enzymes (i.e., "BCFA pathway enzymes") which participate in the conversion of a sugar to the branched α-keto acid molecule 2-keto-3-methylvalerate (also known as α-keto-β-methylvalerate) when the microorganism is cultured in the presence of a carbon source under conditions sufficient to expresses the polynucleotides. The 2-keto-3-methylvalerate molecule is a branched α-keto acid intermediate in the microbial production of anteiso-branched fatty acid derivatives according to the BCFA pathway (see FIG. 2A and FIG. 3B).

In another embodiment, the invention includes a recombinant microbial cell comprising polynucleotides encoding one or more BCFA pathway enzymes which participate in the biosynthesis of an anteiso-branched acyl-ACP intermediate when the microbial cell is cultured in the presence of a carbon source under conditions sufficient to expresses the polynucleotides. In another embodiment, the recombinant microbial cell further comprises one or more polynucleotides encoding one or more polypeptides each having a fatty acid derivative enzyme activity, wherein the recombinant microbial cell produces an anteiso-branched fatty acid derivative when cultured in the presence of a carbon source under conditions sufficient to expresses the polynucleotides.

In another aspect, the invention includes methods for the production of compositions comprising anteiso-branched fatty acid derivatives, comprising culturing a recombinant microbial cell of the invention.

Figure 3A:
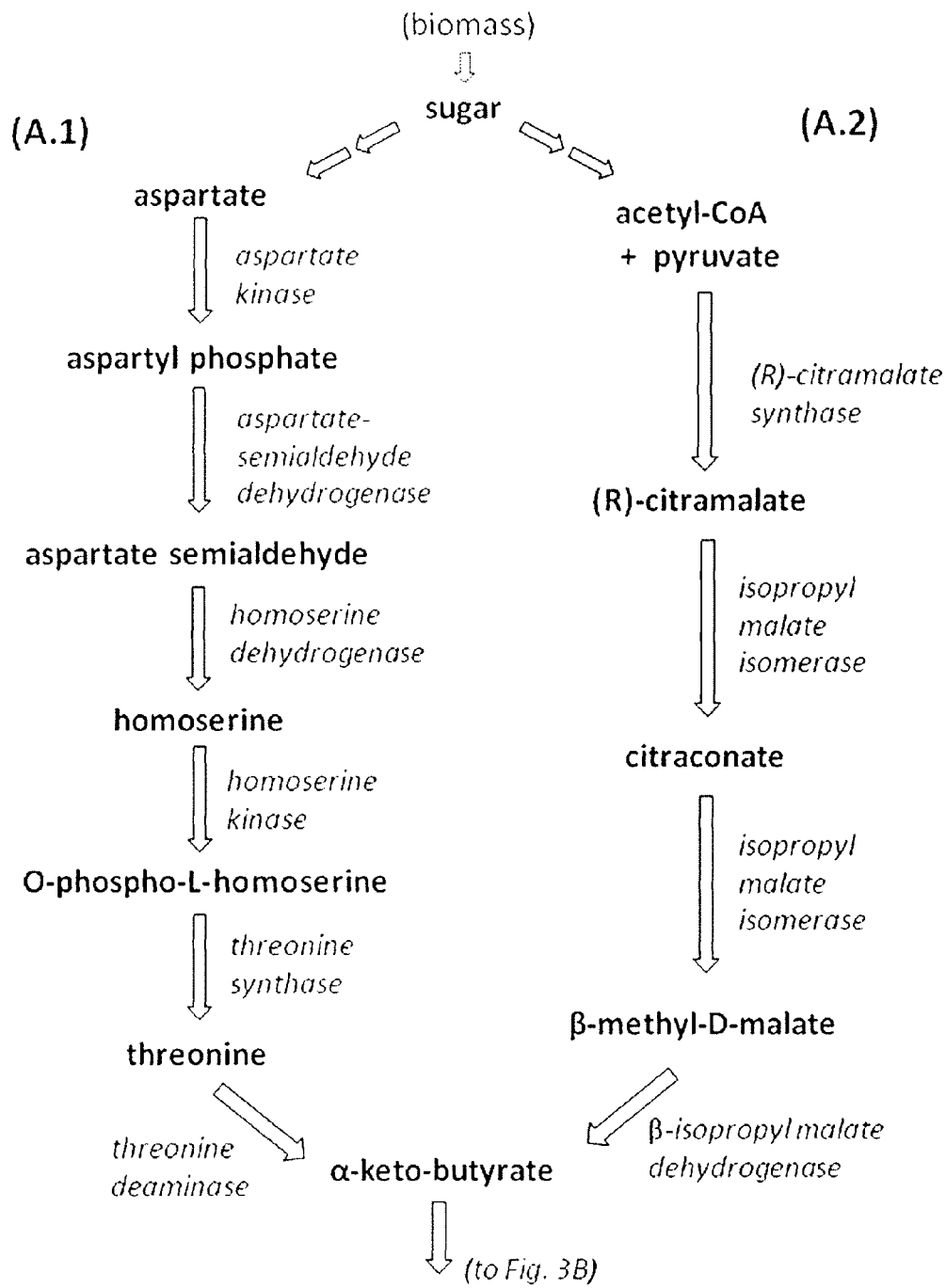
FIGS. 3A and 3B depicts an anteiso-BCFA biosynthetic pathway as described herein.
Figure 3B:
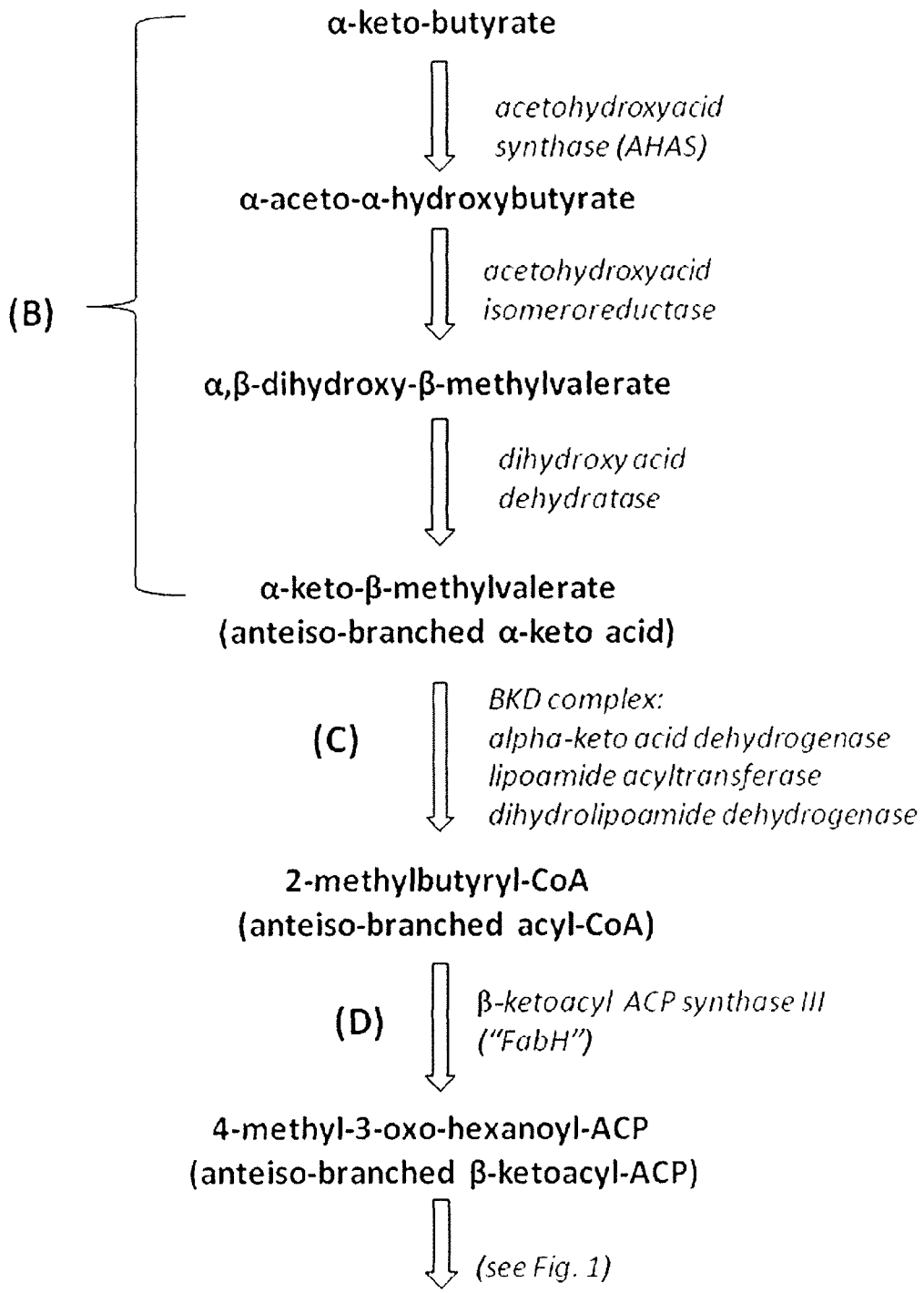

FIGS. 3A and 3B show exemplary biosynthetic pathways for the conversion of a starting material (e.g., a sugar, such as glucose) to an anteiso-branched α-keto acid intermediate, 2-keto-3-methylvalerate, which is then converted to an anteiso-branched acyl-CoA primer, 2-methyl-butyryl-CoA. Condensation of the 2-methyl-butyryl-CoA primer with malonyl-ACP results in an anteiso-branched β-keto acyl-ACP intermediate, 4-methyl-3-oxo-hexanoyl-ACP. The anteiso-branched β-keto acyl-ACP intermediate is a starter unit for further cycles of FAS-catalyzed elongation by condensation with additional malonyl-ACP molecules to generate anteiso-branched acyl-ACP, according to the general pathway diagrammed in FIG. 1. The anteiso-branched acyl-ACP is then converted in further biocatalytic steps, catalyzed by one or more fatty acid derivative enzymes, to produce an anteiso-branched fatty acid derivative.

Pathway Part A: Sugar to 2-Ketobutyrate

To generate the anteiso-branched α-keto acid intermediate 2-keto-3-methylvalerate from the starting material, either or both of two pathways, each which produces a common α-ketobutyrate (2-ketobutyrate) intermediate that is subsequently converted to 2-keto-3-methylvalerate, can be engineered in the recombinant microbial cell. These pathways are diagramed in FIG. 3A.

Pathway Part A.1 (Threonine Intermediate)

The first pathway leading to the common α-ketobutyrate intermediate, as represented by part (A.1) of FIG. 3A, involves production of the pathway intermediate threonine by threonine biosynthetic enzymes, followed by the deamination of threonine to α-ketobutyrate catalyzed by an enzyme with threonine dehydratase activity.

In part (A.1) of the pathway, increasing metabolic flux to the pathway intermediate threonine can be accomplished by expressing polynucleotides encoding enzymes involved in threonine biosynthesis, including enzymes with aspartate kinase activity (e.g., EC 2.7.2.4; also termed aspartokinase activity), which catalyzes the conversion of aspartate to aspartyl phosphate; aspartate-semialdehyde dehydrogenase activity (e.g., EC 1.2.1.11), which catalyzes the conversion of aspartyl phosphate to aspartate semialdehyde; homoserine dehydrogenase activity (e.g., EC 1.1.1.3), which catalyzes the conversion of aspartate semialdehyde to homoserine; homoserine kinase activity (e.g., EC 2.7.1.39), which catalyzes the conversion of homoserine to O-phospho-L-homoserine; and threonine synthase activity (e.g., EC 4.2.3.1), which catalyzes the conversion of O-phospho-L-homoserine to threonine. Not all of the activities listed above need be engineered in the recombinant microbial cell to increase metabolic flux through the threonine intermediate; in some instances, an activity already present in the parental microbial cell (for example, a polypeptide having that activity which is produced in the parental microbial cell by a non-recombinant native gene) will be sufficient to catalyze a step listed above. In one embodiment, the recombinant microbial cell is engineered to recombinantly express one or more polynucleotides selected from: a polynucleotide encoding a polypeptide having aspartate kinase activity, wherein the polypeptide catalyzes the conversion of aspartate to aspartyl phosphate; a polynucleotide encoding a polypeptide having aspartate-semialdehyde dehydrogenase activity, wherein the polypeptide catalyzes the conversion of aspartyl phosphate to aspartate semialdehyde; a polynucleotide encoding a polypeptide having homoserine dehydrogenase activity, wherein the polypeptide catalyzes the conversion of aspartate semialdehyde to homoserine; a polynucleotide encoding a polypeptide having homoserine kinase activity, wherein the polypeptide catalyzes the conversion of homoserine to O-phospho-L-homoserine; a polynucleotide encoding a polypeptide having threonine synthase activity, wherein the polypeptide catalyzes the conversion of O-phospho-L-homoserine to threonine; wherein the recombinant microbial cell has increased metabolic flux through the pathway intermediate threonine compared to the parental microbial cell. In some instances, the polypeptide encoded by recombinantly expressed polynucleotide is present in the recombinant microbial cell at a greater concentration compared to its concentration in the parent microbial cell when cultured under the same conditions, i.e., the polypeptide is "overexpressed" in the recombinant cell. For example, the recombinantly expressed polynucleotide can be operatively linked to a promoter which expresses the polynucleotide in the recombinant microbial cell at a greater concentration than is normally expressed in the parental microbial cell when cultured under the same conditions. In one embodiment, an E. coli thrA gene is used, which encodes a bifunctional ThrA with aspartate kinase and homoserine dehydrogenase activities. In another embodiment, a mutant E. coli thrA gene is used, encoding a variant enzyme with aspartate kinase and homoserine dehydrogenase activities and with reduced feedback inhibition relative to the parent ThrA enzyme (designated ThrA*; Ogawa-Miyata, Y., et al., Biosci. Biotechnol. Biochem. 65:1149-1154 (2001); Lee J.-H., et al., J. Bacteriol. 185: 5442-5451 (2003)).

Threonine can be deaminated to α-ketobutyrate (also known as 2-ketobutyrate, 2-oxobutanoate and 2-oxobutyrate) by an enzyme with threonine deaminase activity (e.g., EC 4.3.1.19; also known as threonine ammonia-lyase activity, and was previously classified as EC 4.2.1.16, threonine dehydratase), which catalyzes the conversion of threonine to α-ketobutyrate. In one embodiment, threonine deaminase activity already present in (i.e., endogenous to) the parental microbial cell is sufficient to catalyze the conversion of threonine to α-ketobutyrate. In another embodiment, the recombinant microbial cell is engineered to recombinantly express a polypeptide having threonine deaminase activity, wherein the polypeptide catalyzes the conversion of threonine to α-ketobutyrate. In some embodiments, the polypeptide having threonine deaminase activity is overexpressed in the recombinant microbial cell.

Non-limiting examples of BCFA pathway enzymes and polynucleotides encoding such enzymes for use in part (A.1) of the branched fatty acid pathway are provided in Table 1.

TABLE 1

Non-limiting examples of enzymes and nucleic acid coding sequences for use in Part A.1 of the anteiso-BCFA biosynthetic pathway shown in FIG. 3A.

| EC Number | Organism | Gene symbol | UniProtKB (SwissProt) Accession Number, or literature reference | NCBI Protein Accession Number | SEQ ID NO: (pp, na) |
| --- | --- | --- | --- | --- | --- |
| EC 2.7.2.4 | | | aspartate kinase (aspartokinase) | | |
| | E. coli K-12 MG1655 | thrA | P00561 | NP_414543 | 116, 117 |
| | E. coli (mutant) | thrA* | Ogawa-Miyata et al, 2001; Lee et al, 2003 | | 118, 119 |
| | B. subtilis 168 | dapG | Q04795 | ZP_03591402 | 120, 121 |
| | P. putida F1 | Pput1442 | A5W0E0 | YP_001266784 | 122, 123 |
| | S. cerevisiae | hom3 | | NP_010972 | 124, 125 |
| EC 1.1.1.3 | | | homoserine dehydrogenase | | |
| | E. coli K12 MG1655 | thrA | P00561 | NP_414543 | 116, 117 |
| | E. coli (mutant) | thrA* | Ogawa-Miyata et al, 2001; Lee et al, 2003 | | 118, 119 |
| | B. subtilis 168 | hom | P19582 | NP_391106 | 126, 127 |
| | P. putida F1 | Pput_4251 | A5W8B5 | YP_001269559 | 128, 129 |
| | S. cerevisiae | hom6 | P31116 | NP_012673 | 130, 131 |

TABLE 1-continued

Non-limiting examples of enzymes and nucleic acid coding sequences for use in Part A.1 of the anteiso-BCFA biosynthetic pathway shown in FIG. 3A.

| EC Number | Organism | Gene symbol | UniProtKB (SwissProt) Accession Number, or literature reference | NCBI Protein Accession Number | SEQ ID NO: (pp, na) |
|---|---|---|---|---|---|
| EC 2.7.1.39 | | | homoserine kinase | | |
| | E. coli K12 MG1655 | thrB | P00547 | NP_414544 | 132, 133 |
| | B. subtilis 168 | thrB | P04948 | NP_391104 | 134, 135 |
| | P. putida F1 | Pput_0138 | A5VWQ3 | YP_001265497 | 136, 137 |
| | S. cerevisiae | thr1 | P17423 | NP_011890 | 138, 139 |
| EC 4.2.3.1 | | | threonine synthase | | |
| | E. coli K12 MG1655 | thrC | P00934 | NP_414545 | 140, 141 |
| | B. subtilis 168 | thrC | P04990 | NP_391105 | 142, 143 |
| | C. glutamicum ATCC 13032 | thrC | P23669 | YP_226461 | 144, 145 |
| EC 4.3.1.19 | | | threonine deaminase (threonine ammonia-lyase; previously termed threonine dehydratase) | | |
| | E. coli K12 MG1655 | tdcB | P0AGF6 | NP_417587 | 146, 147 |
| | E. coli K12 MG1655 | ilvA | P04968 | NP_418220 | 148, 149 |
| | B. subtilis 168 | ilvA | P37946 | NP_390060 | 150, 151 |
| | C. glutamicum ATCC 13032 | ilvA | Q04513 | YP_226365 | 152, 153 |
| | C. glutamicum ATCC 13032 | tdcB | Q8NRR7 | YP_225271 | 154, 155 |

Additional polypeptides can be identified, for example, by searching a relevant database (such as the KEGG database (University of Tokyo), the PROTEIN or the GENE databases (Entrez databases; NCBI), the UNIPROTKB or ENZYME databases (ExPASy; Swiss Institute of Bioinformatics), and the BRENDA database (The Comprehensive Enzyme Information System; Technical University of Braunschweig)), all which are available on the World Wide Web, for polypeptides categorized by the above noted EC numbers. For example, additional aspartokinase polypeptides can be identified by searching for polypeptides categorized under EC 2.7.2.4; additional homoserine dehydrogenase polypeptides can be identified by searching for polypeptides categorized under EC 1.1.1.3; additional homoserine kinase polypeptides can be identified by searching for polypeptides categorized under EC 2.7.1.39; additional threonine synthase polypeptides can be identified by searching for polypeptides categorized under EC 4.2.3.1; and additional threonine deaminase polypeptides can be identified by searching for polypeptides categorized under EC 4.3.1.19.

In some embodiments, a polynucleotide encoding a parent fatty acid pathway polypeptide (such as a polypeptide described in Table 1 or identified by EC number or by homology to an exemplary polypeptide) is modified using methods well known in the art to generate a variant polypeptide having an enzymatic activity noted above (e.g., aspartokinase activity, homoserine dehydrogenase activity, homoserine kinase activity, threonine synthase activity, threonine deaminase activity) and an improved property, compared to that of the parent polypeptide, which is more suited to the microbial cell and/or to the pathway being engineered; such as, for example, increased catalytic activity or improved stability under conditions in which the recombinant microbial cell is cultured; reduced inhibition (e.g., reduced feedback inhibition) by a cellular metabolite or by a culture media component, and the like.

Pathway Part A.2 (Citramalate Intermediate)

The second pathway leading to the common 2-ketobutyrate intermediate, as represented by part (A.2) of FIG. 3A, involves the production of the pathway intermediate citramalate (which is also known as 2-methylmalate) via an enzyme with citramalate synthase activity, and the conversion of citramalate to 2-ketobutyrate by the action of enzymes with isopropylmalate isomerase and alcohol dehydrogenase activities.

Citramalate synthase activity (e.g., EC 2.3.1.182), which catalyzes the reaction of acetyl-CoA and pyruvate to form (R)-citramalate, can be supplied by expression of a cimA gene from a bacterium such as *Methanococcus jannaschi* or *Leptospira interrogans* (Howell, D. M. et al., *J. Bacteriol.* 181(1):331-3 (1999); Xu, H., et al., *J. Bacteriol.* 186:5400-5409 (2004)) which encodes a CimA polypeptide such as CimA from *M. jannaschii* (SEQ ID NO: 156) or *L. interrogans* (SEQ ID NO:160). Alternatively, a modified cimA nucleic acid sequence encoding a CimA variant with improved catalytic activity or stability in the recombinant microbial cell and/or reduced feedback inhibition can be used, such as, for example, a CimA variant described by Atsumi S. and Liao J. C. (*Appl. Environ. Microbiol.* 74(24): 7802-7808 (2008)), preferably the CimA3.7 variant (SEQ ID NO:158) encoded by the cimA3.7 gene (SEQ ID NO:159). Alternatively, a *Leptospira interrogans* CimA variant (SEQ ID NO:162) can be used. Isopropylmalate isomerase activity (EC 4.2.1.33; also termed isopropylmalate dehydratase), which catalyzes the conversion of (R)-citramalate first to citraconate and then to beta-methyl-D-malate, can be provided, for example, by expression of a heterodimeric protein encoded by *E. coli* or *B. subtilis* leuCD genes. Alcohol dehydrogenase activity (EC 1.1.1.85; beta-isopropyl malate dehydrogenase), which catalyzes the conversion of beta-methyl-D-malate to 2-ketobutyrate (i.e., alpha-keto butyrate) can be provided, for example, by expression of an *E. coli* or *B. subtilis* leuB gene or a yeast leu2 gene. Non-limiting examples of fatty acid pathway enzymes and polynucleotides encoding such enzymes for use in engineering part (A.2) of the branched fatty acid pathway are provided in Table 2.

TABLE 2

Non-limiting examples of enzymes and nucleic acid coding sequences for use in Part (A.2) of the anteiso-BCFA biosynthetic pathway shown in FIG. 3A.

| EC number | Organism | Gene symbol | UniProtKB (Swiss-Prot) Protein Accession Number, or literature reference | NCBI Protein Accession Number | SEQ ID NO: (pp, na) |
|---|---|---|---|---|---|
| EC 2.3.1.182 | | | (R)-citramalate synthase | | |
| | M. jannaschii | cimA | Q58787 | NP_248395 | 156, 157 |
| | M. jannaschii (mutant) | cimA 3.7 | Atsumi and Liao (2008) | | 158, 159 |
| | Leptospira interrogans | cimA | Q8F3Q1 | AAN49549 | 160, 161 |
| | Leptospira interrogans (mutant) | cimA* | (this disclosure) | | 162, 163 |
| EC 4.2.1.33 | | | isopropylmalate isomerase (3-isopropylmalate dehydratase) | | |
| | E. coli K12 MG1655 | leuCD | P0A6A6 (C, Lg subunit); P30126 (D, Sm subunit) | (C) NP_414614 (D) NP_414613 | 164, 165 166, 167 |
| | B. subtilis 168 | leuCD | P80858 (C, Lg subunit); P94568 (D, Sm subunit) | (C) NP_390704 (D) NP_390703 | 168, 169 170, 171 |
| EC 1.1.1.85 | | | beta-isopropylmalate dehydrogenase (3-isopropylmalate dehydrogenase) | | |
| | E. coli K12 MG1655 | leuB | P30125 | NP_414615 | 172, 173 |
| | B. subtilis | leuB | P05645 | NP_390705.2 | 174, 175 |
| | S. cerevisiae | leu2 | P04173 | NP_009911.2 | 176, 177 |

Additional polypeptides can be identified, for example, by searching a relevant database (such as the KEGG database (University of Tokyo), the PROTEIN or the GENE databases (Entrez databases; NCBI), the UNIPROTKB or ENZYME databases (ExPASy; Swiss Institute of Bioinformatics), and the BRENDA database (The Comprehensive Enzyme Information System; Technical University of Braunschweig)), all which are available on the World Wide Web, for polypeptides categorized by the above noted EC numbers. For example, additional (R)-citramalate synthase polypeptides can be identified by searching for polypeptides categorized under EC 2.3.1.182; additional isopropyl malate isomerase polypeptides can be identified by searching for polypeptides categorized under EC 4.2.1.33; and additional beta-isopropyl malate dehydrogenase polypeptides can be identified by searching for polypeptides categorized under EC 1.1.1.85.

In some embodiments, a polynucleotide encoding a parent fatty acid pathway polypeptide (such as a polypeptide described in Table 2 or identified by EC number or by homology to an exemplary polypeptide) is modified using methods well known in the art to generate a variant polypeptide having an enzymatic activity noted above (e.g., (R)-citramalate synthase activity, isopropyl malate isomerase activity, beta-isopropyl malate dehydrogenase activity) and an improved property, compared to that of the parent polypeptide, which is more suited to the microbial cell and/or to the pathway being engineered; such as, for example, increased catalytic activity or improved stability under conditions in which the recombinant microbial cell is cultured; reduced inhibition (e.g., reduced feedback inhibition) by a cellular metabolite or by a culture media component, and the like.

Pathway Part B: 2-Ketobutyrate to 2-Keto-3-Methylvalerate

The α-ketobutyrate produced by the first and/or the second pathway can then be converted to the branched α-keto acid, 2-keto-3-methylvalerate, by the action of enzymes with acetohydroxyacid synthase activity (such as, an AHAS complex), acetohydroxyacid isomeroreductase activity, and dihydroxy acid dehydratase activity, as represented by part (B) of FIG. 3B.

Condensation of α-ketobutyrate and pyruvate with concomitant decarboxylation to form the 2-aceto-2-hydroxybutyrate (α-aceto-α-hydroxybutyrate) intermediate can be accomplished by the action of an acetohydroxyacid synthase (AHAS; e.g., EC 2.2.1.6). AHAS (also called acetolactate synthase) is a multisubunit enzyme comprising a large subunit and a small subunit encoded by two genes. There are several AHAS isozymes present in bacteria, fungi and plants. E. coli and various other bacteria contain AHAS isozymes designated AHAS I (e.g., encoded by ilvBN genes), AHAS II (e.g., encoded by ilvGM genes) and AHAS III (e.g., encoded by ilvIH genes). In one embodiment, the acetohydroxyacid synthase activity present in the parental microbial cell is sufficient to catalyze the reaction of 2-ketobutyrate and pyruvate to 2-aceto-2-hydroxybutyrate. In another embodiment, the recombinant microbial cell is engineered to recombinantly express AHAS polypeptides having acetohydroxyacid synthase activity, wherein the AHAS polypeptides catalyze the reaction of 2-ketobutyrate and pyruvate to 2-aceto-2-hydroxybutyrate. In some embodiments, polypeptides having acetohydroxyacid synthase activity are overexpressed in the recombinant microbial cell. If the microbial cell being engineered is an E. coli K-12 strain, and, if E. coli AHAS II activity is desired, an ilvG gene (or an ilvGM gene cluster) must be introduced from a different strain of E. coli, or, the endogenous ilvG gene must be repaired by recombinant methods, since the ilvG gene endogenous to E. coli K-12 is inactive. Alternatively, AHAS I and AHAS III activities present in the parental E. coli K-12 cell (e.g., encoded by endogenous ilvBN and/or ilvIH genes) could be utilized.

Next, conversion of the 2-aceto-2-hydroxybutyrate intermediate to 2,3-dihydroxy-3-methylvalerate (i.e., α,β-dihydroxy-β-methylvalerate) and then to 2-keto-3-methylvalerate (i.e., α-keto-β-methylvalerate or 3-methyl-2-oxopentanoate), can be accomplished by expressing genes encoding enzymes with acetohydroxyacid isomeroreductase activity (e.g., EC 1.1.1.86, encoded by ilvC genes in bacteria and by ilv5 genes in yeast and in plants), which catalyzes the conversion of 2-aceto-2-hydroxybutyrate to 2,3-dihydroxy-3-methylvalerate; and dihydroxy acid dehydratase activity (e.g., EC 4.2.1.9, encoded by ilvD in bacteria and by ilv3 in yeast and in plants), which catalyzes the conversion of 2,3-dihydroxy-3-methylvalerate to 2-keto-3-methylvalerate. In one embodiment, genes endogenous to the parental microbial cell (that is, non-recombinant native host genes), and native enzymes encoded by those endogenous genes, could be utilized for the various steps of part (B) of the pathway. Non-limiting examples of fatty acid pathway enzymes and polynucleotides encoding such enzymes suitable for use in part (B) of the branched fatty acid pathway are provided in Table 3.

an enzymatic activity noted above (e.g., acetohydroxyacid synthase activity, acetohydroxyacid isomeroreductase activity, dihydroxyacid dehydratase activity) and an improved property, compared to that of the parent polypeptide, which is more suited to the microbial cell and/or to the pathway being engineered; such as, for example, increased catalytic activity or improved stability under conditions in which the recombinant microbial cell is cultured; reduced inhibition (e.g., reduced feedback inhibition) by a cellular metabolite or by a culture media component, and the like.

Pathway Part C: Branched Alpha-Keto Acid to Branched Acyl-CoA

The branched acyl-CoA molecule is generated from the branched α-keto acid, as represented by part (C) of FIGS. 1 and 3B, by the action of a multi-component branched chain alpha-keto acid dehydrogenase (BKD) complex. Polynucle-

TABLE 3

Non-limiting examples of enzymes and coding sequences for use in Part (B) of the anteiso-BCFA biosynthetic pathway shown in FIG. 3B.

| EC number | Organism | Gene symbol | UniProtKB (Swiss-Prot) Protein Accession Number, or literature reference | NCBI Protein Accession Number | SEQ ID NO: (pp, na) |
|---|---|---|---|---|---|
| EC 2.2.1.6 | | | acetohydroxyacid synthase acetolactate synthase) | | |
| | E. coli K-12 MG1655 | ilvBN | (AHAS I) (ilvB) P08142 (ilvN) P0ADF8 | (B) NP_418127 (N) NP_418126 | 178, 179 180, 181 |
| | E. coli B | ilvGM | (AHAS II) (ilvG) C6UI83 (ilvM) C6UI84 | (G) YP_003046821 (M) YP_003046822 | 182, 183 184, 185 |
| | E. coli K-12 MG1655 | ilvIH | (AHAS III) (ilvI) P00893 (ilvH) P00894 | (I) YP_025294.2 (H) NP_414620 | 186, 187 188, 189 |
| | L. monocytogenes 08-5578 | ilvBN | (ilvB) D2NVG7 (ilvN) D2NVG8 | (B) YP_003414294 (N) YP_003414295 | 190, 191 192, 193 |
| EC 1.1.1.86 | | | acetohydroxyacid isomeroreductase (ketol-acid reductoisomerase) | | |
| | E. coli K-12 MG1655 | ilvC | P05793 | NP_418222 | 194, 195 |
| | B. subtilis 168 | ilvC | P37253 | NP_390707 | 196, 197 |
| EC 4.2.1.9 | | | dihydroxyacid dehydratase | | |
| | E. coli K-12 MG1655 | ilvD | P05791 | YP_026248 | 198, 199 |
| | B. subtilis 168 | ilvD | P51785 | NP_390070.2 | 200, 201 |

Additional polypeptides can be identified, for example, by searching a relevant database (such as the KEGG database (University of Tokyo), the PROTEIN or the GENE databases (Entrez databases; NCBI), the UNIPROTKB or ENZYME databases (ExPASy; Swiss Institute of Bioinformatics), and the BRENDA database (The Comprehensive Enzyme Information System; Technical University of Braunschweig)), all which are available on the World Wide Web, for polypeptides categorized by the above noted EC numbers. For example, additional acetohydroxyacid synthase polypeptides can be identified by searching for polypeptides categorized under EC 2.2.1.6; additional acetohydroxyacid isomeroreductase polypeptides can be identified by searching for polypeptides categorized under EC 1.1.1.86; and additional dihydroxyacid dehydratase polypeptides can be identified by searching for polypeptides categorized under EC 4.2.1.9.

In some embodiments, a polynucleotide encoding a parent fatty acid pathway polypeptide (such as a polypeptide described in Table 3 or identified by EC number or by homology to an exemplary polypeptide) is modified using methods well known in the art to generate a variant polypeptide having otides encoding components of the BKD complex can be obtained from a microbial cell that normally produces branched chain fatty acids or can metabolize branched amino acids or branched α-ketoacids (including, but not limited to, strains of Bacillus, Pseudomonas, Streptomyces, Listeria, Staphylococcus, and Streptococcus).

The BKD complex comprises at least two components: an E1 component having alpha-keto acid dehydrogenase activity (e.g., EC 1.2.4.4), and which, depending on the source, may be a single polypeptide (that is, a monomer), or, a heterodimer denoted E1alpha and E1beta; and a E2 component having lipoamide acyltransferase activity (e.g., EC 2.3.1.168). Both the E1 (or E1alpha/E1beta) and E2 components utilize branched substrates. In some instances, the BDK complex comprises a third component, denoted E3, having dihydrolipoamide dehydrogenase activity (e.g., EC 1.8.1.4); in some instances, an enzyme having dihydrolipoamide dehydrogenase activity and which utilizes branched chain substrates can be obtained from a microbial cell which does not normally produce branched fatty acids (such as E. coli), which may be used in place of a BKD E3 component.

To engineer part (C) of the pathway, the branched chain alpha-keto acid dehydrogenase activity (E1 activity, e.g., EC 1.2.4.4) and the lipoamide acyltransferase activity (E2 activity, e.g., EC 2.3.1.168) of the BKD complex can be introduced by expression of polynucleotides encoding BKD E1 (or E1alpha/beta) and E2 component polypeptides from microorganisms that normally produce branched fatty acids or can metabolize branched amino acids or branched α-ketoacids, such as, for example, *Bacillus subtilis, Pseudomonas putida, Listeria monocytogenes, Micrococcus luteus*, and *Streptococcus mutans*. Dihydrolipoamide dehydrogenase activity (E3 activity, e.g., EC 1.8.1.4) can likewise be introduced by expression of a polynucleotide encoding an E3 component from a microorganism that normally produces branched chain fatty acids; alternatively, a polynucleotide encoding a polypeptide with dihydrolipoyl dehydrogenase activity from a microorganism that normally does not produce branched chain fatty acids, but which nevertheless utilizes branched chain substrates (for example, an *E. coli* dihydrolipoyl dehydrogenase), can be used. If the recombinant microbial cell being engineered is one that normally produces branched chain fatty acids (and, as such, produces an endogenous BKD complex), one or more endogenous BKD complex components can be overexpressed.

Non-limiting examples of fatty acid pathway enzymes and polynucleotides encoding such enzymes for use in engineering part (C) of the branched fatty acid pathway are provided in Table 4.

TABLE 4

Non-limiting examples of BKD complex polypeptides and coding sequences for use in Part C of the BCFA biosynthetic pathways shown in FIGS. 1 and 3B.

| EC number | Organism | Gene symbol | UniProtKB (Swiss-Prot) Protein Accession Number, or literature reference | NCBI Protein Accession Number | SEQ ID NO: pp, na |
|---|---|---|---|---|---|
| EC 1.2.4.4 | branched chain alpha-keto acid dehydrogenase (branched chain alpha-keto acid decarboxylase; 3-methyl-2-oxobutanoate dehydrogenase (2-methylpropanoyl-transferring); 2-oxoisovalerate dehydrogenase; BKD E1 complex component) | | | | |
| | *B. subtilis* 168 | bkdAA | P37940 (E1a) | NP_390285 (E1a) | 1, 2 |
| | | bkdAB | P37941 (E1b) | NP_390284 (E1b) | 22, 23 |
| | *Streptomyces avermitilis* MA-4860 | bkdA | Q53592 | NP_825539 | 3, 4 |
| | | bkdB | Q82F97 | NP_825540 | 24, 25 |
| | *Pseudomonas putida* F1 | Pput_1453 | A5W0F1 | YP_001266795 | 5, 6 |
| | | Pput_1452 | A5W0F0 | YP_001266794 | 26, 27 |
| | *Listeria monocytogenes* 08-5578 | LM5578_1512 | D2P1Z6 | YP_003413622 | 7, 8 |
| | | LM5578_1513 | D2P1Z7 | YP_003413623 | 28, 29 |
| | *Micrococcus luteus* NCTC 2655 | Mlut_06800 | C5C9R0 | YP_002956766 | 9, 10 |
| | | Mlut_06810 | C5C9R1 | YP_002956767 | 30, 31 |
| | *Staphylococcus aureus* A8819 | | D4UFQ9 | ZP_06816445 | 11, 12 |
| | | | D4UFQ8 | ZP_06816444 | 32, 33 |
| | *Streptococcus mutans* UA159 | adhA | Q8DWD7 | NP_720600 | 13, 14 |
| | | adhB | Q8DWD6 | NP_720601 | 34, 35 |
| EC 2.3.1.168 | lipoamide acyltransferase (dihydrolipoyl transacylase; dihydrolipoyllysine-residue (2-methylpropanoyl) transferase; BKD E2 complex component) | | | | |
| | *B. subtilis* 168 | bkdB | P37942 | NP_390283 | 43, 44 |
| | *Streptomyces avermitilis* MA-4860 | bkdC | Q82F96 | NP_825541 | 45, 46 |
| | *Pseudomonas putida* F1 | Pput_1451 | A5W0E9 | YP_001266793 | 47, 48 |
| | *Listeria monocytogenes* 08-5578 | LM5578_1514 | D2P1Z8 | YP_003413624 | 49, 50 |
| | *Micrococcus luteus* NCTC 2655 | Mlut_06810 | C5C9R1 | YP_002956767 | 51, 52 |
| | *Staphylococcus aureus* JH1 | SaurJH1_1607 | A6U1Y7 | YP_001316742 | 53, 54 |
| | *Streptococcus mutans* UA159 | adhC | Q8DWD5 | NP_720602 | 55, 56 |
| EC 1.8.1.4 | dihydrolipoamide dehydrogenase (dihydrolipoyl dehydrogenase; BKD E3 complex component) | | | | |
| | *Bacillus subtillis* 168 | lpdV | P54533 | NP_390286.2 | 63, 64 |
| | *Streptomyces avermitilis* MA-4860 | lpdA1 | Q82AN3 | NP_827200.2 | 65, 66 |
| | *Pseudomonas putida* F1 | Pput_1450 | A5W0E8 | YP_001266792 | 67, 68 |
| | *Listeria monocytogenes* 08-5578 | pdhD | D2P0X6 | YP_003413252 | 69, 70 |

TABLE 4-continued

Non-limiting examples of BKD complex polypeptides and coding sequences for use
in Part C of the BCFA biosynthetic pathways shown in FIGS. 1 and 3B.

| EC number | Organism | Gene symbol | UniProtKB (Swiss-Prot) Protein Accession Number, or literature reference | NCBI Protein Accession Number | SEQ ID NO: pp, na |
|---|---|---|---|---|---|
| | *Micrococcus luteus* NCTC 2655 | Mlut_05640 | C5C9F0 | YP_002956656 | 71, 72 |
| | *Staphylococcus aureus* ED98 | lpdA | D0K5A1 | YP_003282417 | 73, 74 |
| | *Streptococcus mutans* UA159 | adhD | Q8DWD4 | NP_720603 | 75, 76 |
| | *E. coli* | lpdA | P0A9P0 | NP_414658 | 77, 78 |

Additional polypeptides can be identified, for example, by searching a relevant database (such as the KEGG database (University of Tokyo), the PROTEIN or the GENE databases (Entrez databases; NCBI), the UNIPROTKB or ENZYME databases (ExPASy; Swiss Institute of Bioinformatics), and the BRENDA database (The Comprehensive Enzyme Information System; Technical University of Braunschweig)), all which are available on the World Wide Web, for polypeptides categorized by the above noted EC numbers. For example, additional branched chain alpha-keto acid dehydrogenase polypeptides can be identified by searching for polypeptides categorized under EC 1.2.4.4; additional lipoamide acyltransferase polypeptides can be identified by searching for polypeptides categorized under EC 2.3.1.168; and additional dihydrolipoyl dehydrogenase polypeptides can be identified by searching for polypeptides categorized under EC 1.8.1.4.

BKD complex component polypeptides (such as, branched chain alpha-keto acid dehydrogenase polypeptides, lipoamide acyltransferase polypeptides, and dihydrolipoyl dehydrogenase polypeptides) can also be identified by searching a sequence pattern database, such as the Prosite database (ExPASy Proteomics Server, Swiss Institute of Bioinformatics) for a polypeptide comprising one or more of the sequence motifs listed below. This is readily accomplished, for example, by using the ScanProsite tool which is available on the World Wide Web site of the ExPASy Proteomics Server.

In one embodiment, a branched chain alpha-keto acid dehydrogenase (BKD E1-alpha subunit) polypeptide comprises one or more sequence motif selected from:

(SEQ ID NO: 15)
[S,Q]-x(2)-G-[Q,E]-E-A-x(3)-[G,A]-x-[G,A]-x-[V,A]-[L,T]

(SEQ ID NO: 16)
D-x(2)-[L,F]-P-x-Y-R (SEQ ID NO: 17)
[S,T]-Q-x(2)-[H,Q]-A-[T,V]-G-x-A-[A,G]

(SEQ ID NO: 18)
[K,G]-x-[T,D]-x(2)-[A,V]-x-[A,V]-x(2)-G-[E,D]-G-x(4)-[G,S]-D-[F,V]

(SEQ ID NO: 19)
F-[A,S]-[H,A]-V-x(2)-[L,A]-P-V-x-[L,F]-x(3)-N-N-x(2)-A-I-S

-continued (SEQ ID NO: 20)
[K,R]-[G,A]-x-G-[C,Y]-[F,G]-x-[A,P]-[S,G]-x(2)-V-D-G-N-D (SEQ ID NO: 21)
[H,R]-A-R-[A,R]-G-x-G-P-x-L-x-E-x(2)-[S,T]-Y-R-x(3)-H-x(3)-D-D-x(3)-Y-R wherein the amino acid residues in each of the brackets indicate alternative amino acid residues at the particular position, each x indicates any amino acid residue, and each n in "x(n)" indicates the number of x residues in a contiguous stretch of amino acid residues.

In another embodiment, a branched chain alpha-keto acid dehydrogenase (BKD E1-beta subunit) polypeptide comprises one or more sequence motif selected from:

(SEQ ID NO: 36)
V-x-[V,I]-x-G-[Q,E]-D-V-G-x(2)-G-G-V-F-[R,K]-x-T-x-G-I (SEQ ID NO: 37)
[Y,F]-G-[E,K]-x-R-[C,V]-x-D-[A,T]-P-[L,I]-[A,S]-E-[A,S]-[A,G]-I (SEQ ID NO: 38)
G-T-[A,E]-x-[R,Y]-G-x-R-P-[I,V]-[A,V]-E-x-Q-F (SEQ ID NO: 39)
P-[C,Y]-G-G-[V,I]-x-[A,G]-x(3)-H-S-x-S-x-E-A-x-[F,Y]

(SEQ ID NO: 40)
[E,D]-D-P-V-x-[F,Y]-x-E-[H,P]-K-R-x-Y (SEQ ID NO: 41)
[H,E]-V-[I,V]-D-L-R-[T,S]-x(2)-P-x-D (SEQ ID NO: 42)
E-x-C-[L,F]-x-[D,H]-L-[D,E]-A-P-x(2)-R-[L,V]-x-G-x-[H,D]-P wherein the amino acid residues in each of the brackets indicate alternative amino acid residues at the particular position, each x indicates any amino acid residue, and each n in "x(n)" indicates the number of x residues in a contiguous stretch of amino acid residues.

In another embodiment, a lipoamide acyltransferase (BKD E2 component) polypeptide comprises one or more sequence motif selected from:

P-x-V-[L,R]-x-[R,L]-A-x(3)-G-x-[D,E]-L (SEQ ID NO: 57)

[G,P]-[S,T]-G-[A,P]-x-G-x-I (SEQ ID NO: 58)

[V,I]-P-[L,V]-x-G-[L,V]-R-x-[A,K]A-x(2)-[L,M]-x(2)-[A,S] (SEQ ID NO: 59)

G-[G,S]-T-x-T-x(2)-[N,S]-x-G-x-[F,L]-G (SEQ ID NO: 60)

N-x-P-E-x-A-[I,M]-[L,V]-x-V-x(2)-[I,M]-x(3)-P-x-V (SEQ ID NO: 61)

L-x-[L,S]-[S,T]-F-[D,L]-H-R-[V,L]-x-D-G (SEQ ID NO: 62)

wherein the amino acid residues in each of the brackets indicate alternative amino acid residues at the particular position, each x indicates any amino acid residue, and each n in "x(n)" indicates the number of x residues in a contiguous stretch of amino acid residues.

In another embodiment, a dihydrolipoyl dehydrogenase (BKD E3 component) polypeptide comprises one or more sequence motif selected from:

[I,V]-G-G-[A,T]-[S,C]-[V,L]-x(2)-[G,D]-C-[V,I]-P-[T,S]-K-[A,T]-[M,L]-[I,L] (SEQ ID NO: 79)

[L,I]-A-T-G-[G,S]-x-[S,P]-x(2)-L-[A,P]-[D,G]-x(3)-[D,L]-G (SEQ ID NO: 80)

[V,I]-x-G-[G,S]-G-x-[I,T]-G-x-E-x-[A,G] (SEQ ID NO: 81)

T-x(6)-[A,V]-x-G-D-x(2)-[P,G] (SEQ ID NO: 82)

[I,V]-[G,A]-x(2)-[F,I]-[T,H]-x-[Y,H]-P-[S,T]-[Q,L] (SEQ ID NO: 83)

wherein the amino acid residues in each of the brackets indicate alternative amino acid residues at the particular position, each x indicates any amino acid residue, and each n in "x(n)" indicates the number of x residues in a contiguous stretch of amino acid residues.

In some embodiments, a polynucleotide encoding a parent fatty acid pathway polypeptide (such as a BKD complex polypeptide described in Table 4 or identified by EC number or by motif or by homology to an exemplary polypeptide) is modified using methods well known in the art to generate a variant polypeptide having BKD complex enzymatic activity and an improved property, compared to that of the parent polypeptide, which is more suited to the microbial cell and/or to the pathway being engineered; such as, for example, increased catalytic activity or improved stability under conditions in which the recombinant microbial cell is cultured; reduced inhibition (e.g., reduced feedback inhibition) by a cellular metabolite or by a culture media component, and the like.

BKD complex enzymatic activity can be measured according to various known protocols. For example, Sokatch et al. described an assay mixture containing: 100 mM potassium phosphate buffer (pH 7.0), 2 mM NAD+, 0.1 mM coenzyme A, 0.2 mM dithiothreitol, 0.2 mM thiamine pyrophosphate, 1 mM magnesium chloride, and 5 mM L-valine. The reaction can be initiated by adding 4.0 μmoL of the sodium salt of a branched-chain α-keto acid substrate, such as 2-keto-3-methylvalerate (Sokatch et al., *J. Bacteriology* 148(2):647-652 (1981)).

Pathway Part D: Branched Acyl-CoA to Branched β-Ketoacyl-ACP

As noted above, the branched acyl-CoA serves as a primer for subsequent FAS-catalyzed elongation steps. The initiation of this process involves condensation of the branched acyl-CoA with a malonyl-ACP molecule to form a branched β-ketoacyl-ACP intermediate. For example, the anteiso-branched acyl-CoA molecule 2-methylbutyryl-CoA can condense with malonyl-ACP to form an anteiso-branched β-ketoacyl-ACP intermediate 4-methyl-3-oxo-hexanoyl-ACP, while the iso-branched acyl-CoA molecule isobutyryl-CoA can condense with malonyl-ACP to form an iso-branched β-ketoacyl-ACP intermediate 4-methyl-3-oxo-pentanoyl-ACP (FIGS. 2A and 2B).

This initiation step, as represented by part (D) of FIGS. 1 and 3, is catalyzed in the recombinant microbial cell by an enzyme having beta-ketoacyl-ACP synthase activity (such as, a Type III beta-ketoacyl-ACP synthase (e.g., EC 2.3.1.180)) that utilizes branched acyl-CoA molecules (for example, anteiso-branched acyl-CoA molecules) as substrates. Such an enzyme is also referred to herein as an enzyme having "branched chain beta-ketoacyl-ACP synthase activity". A polynucleotide sequence encoding an polypeptide having branched chain beta-ketoacyl-ACP synthase activity can be obtained from a microbial cell that normally produces branched chain fatty acids (including, but not limited to, strains of *Bacillus, Streptomyces, Stenotrophomonas, Listeria, Staphylococcus*, and *Streptococcus*), and expressed or overexpressed in the recombinant microbial cell.

In some instances, one or more enzymes endogenous to the parental microbial cell might compete for substrate with enzymes of the engineered branched fatty acid biosynthetic pathway in the recombinant microbial cell, or might break down or otherwise divert an intermediate in the biosynthetic pathway; genes encoding such undesired endogenous enzymes can be attenuated to increase branched fatty acid production in the recombinant microbial cell. For example, in *E. coli*, the endogenous β-ketoacyl-ACP synthase III (UniProtKB/Swiss-Prot Protein Accession Number P0A6R0), encoded by the *E. coli* fabH gene, primarily utilizes short straight-chain acyl-CoA molecules such as acetyl-CoA, but does not utilize branched acyl-CoA molecules, and thus competes with enzymes of the branched chain pathway for malonyl-ACP and other substrates and diverts flux away from the BCFA pathway. Deleting or otherwise attenuating the *E. coli* fabH gene thus directs fatty acid biosynthesis in a recombinant *E. coli* comprising a BCFA pathway more towards the production of branched fatty acids. Other endogenous enzymes that may be undesired and which may be attenuated in the recombinant microbial cell include, for example, the *E. coli* fadE gene encoding an acyl-CoA dehydrogenase which metabolizes acyl-CoA intermediates.

Non-limiting examples of fatty acid pathway enzymes and polynucleotides encoding such enzymes for use in engineering part D of the branched fatty acid pathway are provided in Table 5.

TABLE 5

Non-limiting examples of enzymes and coding sequences for use in Part D of the BCFA biosynthetic pathways shown in FIGS. 1 and 3B.

| EC number | Organism | Gene symbol | UniProtKB (Swiss-Prot) Protein Accession Number, or literature reference | NCBI Protein Accession Number | SEQ ID NO: pp, na |
|---|---|---|---|---|---|
| EC 2.3.1.180 | | | beta-ketoacyl-ACP synthase III | | |
| | B. subtilis 168 | fabH1 | O34746 | NP_389015 | 84, 85 |
| | B. subtilis 168 | fabH2 | O07600 | NP_388898 | 86, 87 |
| | Staphylococcus aureus MW2 | fabH | Q8NXE2 | NP_645682 | 88, 89 |
| | Streptomyces avermitilis MA-4680 | fabH3 | Q82KT2 | NP_823466 | 90, 91 |
| | Streptococcus mutans UA159 | fabH | Q8DSN2 | NP_722071 | 92, 93 |
| | Lactococcus lactis subsp. lactis | fabH | Q9CHG0 | NP_266927 | 94, 95 |
| | Streptomyces coelicolor | fabH | Q9K3G9 | CAB99151 | 96, 97 |
| | Listeria monocytogenes | fabH | B8DFA8 | YP_002349314 | 98, 99 |
| | L. monocytogenes (mutant) | fabH2 | (this disclosure) | | 100, 101 |
| | Bacteroides vulgatus | fabH | A6KXK3 | YP_001297789 | 102, 103 |
| | Clostridium acetobutylicum | fabH | Q97DA2 | NP_350161 | 104, 105 |
| | Flavobacterium johnsoniae | fabH2 | A5FM89 | YP_001193000 | 106, 107 |
| | Micrococcus luteus | fabH | C5CAR9 | YP_002957006 | 108, 109 |

Additional beta-ketoacyl-ACP III synthase polypeptides can be identified, for example, by searching a relevant database (such as the KEGG database (University of Tokyo), the PROTEIN or the GENE databases (Entrez databases; NCBI), the UNIPROTKB or ENZYME databases (ExPASy; Swiss Institute of Bioinformatics), and the BRENDA database (The Comprehensive Enzyme Information System; Technical University of Braunschweig)), all which are available on the World Wide Web, for polypeptides categorized under EC 2.3.1.180.

Additional beta-ketoacyl-ACP synthase III polypeptides can also be identified by searching a sequence pattern database, such as the Prosite database (ExPASy Proteomics Server, Swiss Institute of Bioinformatics) for a polypeptide comprising one or more of the sequence motifs listed below. This is readily accomplished, for example, by using the Scan-Prosite tool which is available on the World Wide Web site of the ExPASy Proteomics Server.

In one embodiment, a beta-ketoacyl-ACP synthase III polypeptide comprises one or more sequence motif selected from:

```
                                     (SEQ ID NO: 110)
D-T-[N,S]D-[A,E]-W-I-x(2)-[M,R]-T-G-I-x-[N,E]-

R-[R,H]

(SEQ ID NO: 111)
[S,A]-x-D-x(2)-A-[A,V]-C-[A,S]-G-F-x(3)-[M,L]- x(2)-A (SEQ ID NO: 112)
D-R-x-T-[A,I]-[I,V]-x-F-[A,G]-D-G-A-[A,G]-[G,A]-

[A,V]
```

-continued
```
                                     (SEQ ID NO: 113)
H-Q-A-N-x-R-I-[M,L]

(SEQ ID NO: 114)
G-N-T[G,S]-A-A-S-[V,I]-P-x(2)-[I,L]-x(6)-G (SEQ ID NO: 115)
[I,V]-x-L-x(2)-F-G-G-G-[L,F]-[T,S]-W-G
``` wherein the amino acid residues in each of the brackets indicate alternative amino acid residues at the particular position, each x indicates any amino acid residue, and each n in "x(n)" indicates the number of x residues in a contiguous stretch of amino acid residues.

In some embodiments, a polynucleotide encoding a parent fatty acid pathway polypeptide (such as a polypeptide described in Table 5 or identified by EC number or by motif or by homology to an exemplary polypeptide) is modified using methods well known in the art to generate a variant polypeptide having branched chain beta-ketoacyl-ACP III synthase activity, and an improved property, compared to that of the parent polypeptide, which is more suited to the microorganism and/or to the pathway being engineered; such as, for example, increased catalytic activity or improved stability under conditions in which the recombinant microbial cell is cultured, reduced inhibition (e.g., reduced feedback inhibition) by a cellular metabolite or by a culture media component, and the like.

The invention includes an isolated polypeptide comprising a sequence having at least 80% identity to one of SEQ ID NOs:84, 86, 88, 90, 92, 94, 96, 98, 102, 104, 106, and 108, and comprising a substitution at position W310 or at an equivalent position thereto, wherein the polypeptide has beta-ketoacyl-ACP synthase activity. The invention also includes an isolated polynucleotide encoding any one of said polypeptides. In one embodiment, the polypeptide comprises a W310G substitution. In one embodiment, the polypeptide comprises a sequence having at least 80% identity to SEQ ID NO: 98 and comprises the substitution W310G. In another embodiment the polypeptide comprises the sequence SEQ ID NO:100. In some embodiments, the polynucleotide encodes the sequence SEQ ID NO:100, or comprises the sequence SEQ ID NO:101.

Enzymatic activity and specificity for branched substrates of beta ketoacyl-ACP synthases can be determined using known methods. For example, Choi et al. (*J. Bacteriology* 182(2):365-370 (2000)) described in detail a filtered disc assay suitable for determining β-ketoacyl-ACP synthase ("FabH") activity against acetyl-CoA substrates, which can be modified to use branched-chain acyl-CoA substrates. The assay contains 25 μM ACP, 1 mM β-mercaptoethanol, 65 μM malonyl-CoA, 45 μM [1-$^{14}$C]acetyl-CoA (specificity activity about 45.8 Ci/mol), *E. coli* FadD (0.2 μg), and 0.1 M sodium phosphate buffer (pH 7.0) in a final volume of 40 μL. To assay branched-chain β-ketoacyl-ACP synthase activity, [1-$^{14}$C] acetyl-CoA can be substituted with a $^{14}$C labeled branched acyl-CoA. The reaction is initiated by the addition of FabH, and the mixture is incubated at 37° C. for 12 minutes. A 35 mL aliquot is then removed and deposited on a Whatman 3 MM filter disc. The discs are then washed with three changes (20 mL/disc for 20 minutes each) of ice-cold trichloroacetic acid. The concentration of the trichloroacetic acid is then reduced from 10 to 5 to 1% in each successive wash. The filters are dried an counted in 3 mL of scintillation cocktail.

Alternatively, FabH activity can be determined using gel electrophoresis to separate and quantitate the products (Choi et al., supra). The assay mixture contains 25 μM ACP, 1 mM β-mercaptoethanol, 70 μM [2-$^{14}$C]malonyl-CoA (specific activity, ~9 Ci/mol), 45 μM of a CoA-substrate (such as acetyl-CoA; or, to assay branched-chain β-ketoacyl-ACP synthase, isobutyryl-CoA, isovaleryl-CoA, or 2-methylbutyryl-CoA), FadD (0.2 μg), 100 mM NADPH, FabG (0.2 μg) and 0.1 M sodium phosphate buffer (pH 7.0) in a final volume of 40 μL. The reaction can be initiated by the addition of FabH. The mixture is incubated at 37° C. for 12 minutes and then placed in an ice slurry, gel loading buffer is then added, and the mixture is loaded onto a conformationally sensitive 13% polyacrylamide gel containing 0.5 to 2.0 M urea. Electrophoresis can be performed at 25° C. at 32 mA/gel. The gels are then dried, and the bands quantitated by exposure of the gel to a Phospholmager screen. Specific activity can be calculated from the slopes of the plot of product formation vs. FabH protein concentration in the assay.

Pathway Part E: Branched β-Ketoacyl-ACP to Branched Fatty Acyl-ACP

The branched β-ketoacyl-ACP intermediate generated in part (D) can undergo elongation by successive cycles of condensation with malonyl-ACP/keto-reduction/dehydration/enoyl-reduction, catalyzed by a fatty acid synthase (FAS) complex, such as, for example, a type II fatty acid synthase complex, thereby adding 2-carbon units to the lengthening fatty acid chain of the resulting branched acyl-ACP, as represented by part (E) of FIG. 1. In one embodiment, an anteiso-branched β-ketoacyl-ACP intermediate produces an anteiso-branched acyl-ACP intermediate. In another embodiment, an iso-branched β-ketoacyl-ACPintermediate produces an iso-branched acyl-ACP intermediate. In one embodiment, a FAS enzyme complex (such as, for example, a Type II FAS complex) endogenous to the microbial cell is used to catalyze cycles of condensation with malonyl-ACP/keto-reduction/dehydration/enoyl-reduction to produce the branched acyl-ACP intermediate.

Branched Fatty Acid Derivatives

Branched fatty acid derivatives (including branched fatty acids, branched fatty esters, branched fatty aldehydes, branched fatty alcohols, branched hydrocarbons, and branched ketones, in iso-branched or anteiso-branched form) can be produced by a recombinant microbial cell of the invention. The branched acyl-ACP intermediate is converted to a fatty acid derivative in a reaction catalyzed by an enzyme having fatty acid derivative activity (i.e., a fatty acid derivative enzyme). A fatty acid derivative enzyme can, for example, convert a branched acyl-ACP to an initial fatty acid derivative, or, can convert the initial fatty acid derivative to a second fatty acid derivative. In some instances, the initial fatty acid derivative is converted to a second fatty acid derivative by an enzyme having a different fatty acid derivative activity. In some instances, the second fatty acid derivative is further converted to a third fatty acid derivative by another fatty acid derivative enzyme, and so on.

Accordingly, in some embodiments, the recombinant microbial cell further comprises one or more polynucleotides, each polynucleotide encoding a polypeptide having a fatty acid derivative enzyme activity, wherein the recombinant microbial cell produces a branched fatty acid derivative when cultured in the presence of a carbon source under conditions effective to express the polynucleotides.

In various embodiments, the fatty acid derivative activity comprises thioesterase activity, wherein the recombinant microbial cell produces branched fatty acids; ester synthase activity, wherein the recombinant microbial cell produces branched fatty esters; fatty aldehyde biosynthesis activity, wherein the recombinant microbial cell produces branched fatty aldehydes; fatty alcohol biosynthesis activity, wherein the recombinant microbial cell produces branched fatty alcohols; ketone biosynthesis activity, wherein the recombinant microbial cell produces branched ketones; or hydrocarbon biosynthesis activity, wherein the recombinant microbial cell produces branched hydrocarbons. In some embodiments, the recombinant microbial cell comprises polynucleotides encoding two or more polypeptides, each polypeptide having fatty acid derivative enzyme activity.

In more particular embodiments, the recombinant microbial cell expresses or overexpresses one or more polypeptides having fatty acid derivative enzyme activity as described hereinabove, wherein the recombinant microbial cell produces a composition comprising branched fatty acids, branched fatty esters, branched wax esters, branched fatty aldehydes, branched fatty alcohols, branched alkanes, branched alkanes branched internal olefins, branched terminal olefins, or branched ketones.

The following are further examples of fatty acid derivative enzymes, and fatty acid derivatives produced by reactions catalyzed by such enzymes, in accordance with various embodiments of the invention.

Branched Fatty Acid

In one embodiment, the recombinant microbial cell comprises a polynucleotide encoding a thioesterase, and the branched fatty acyl-ACP intermediate produced by the recombinant microbial cell is hydrolyzed by the thioesterase (e.g., 3.1.1.5, EC 3.1.2.-; such as, for example, EC 3.1.2.14) resulting in production of a branched fatty acid. In some embodiments, a composition comprising branched fatty acids (also referred to herein as a "branched fatty acid composition") is produced by culturing the recombinant cell in the presence of a carbon source under conditions effective to express the polynucleotides. In some embodiments, the composition is recovered from the cell culture. In some embodiments, the recombinant microbial cell comprises a polynucleotide encoding a polypeptide having thioesterase activity, and one or more additional polynucleotides encoding polypeptides having other fatty acid derivative enzyme activities. In some such instances, the branched fatty acid produced by the action of the thioesterase is converted by one or more enzymes having different fatty acid derivative enzyme activities to another branched fatty acid derivative, such as, for example, a branched fatty ester, a branched fatty aldehyde, a branched fatty alcohol, or a branched hydrocarbon.

In one embodiment, an anteiso-branched fatty acyl-ACP intermediate reacts with a thioesterase to form an anteiso-branched fatty acid. The anteiso-branched fatty acid can be recovered from the cell culture, or can be further converted to another anteiso-branched fatty acid derivative, such as an anteiso-branched fatty ester, an anteiso-branched fatty aldehyde, an anteiso-branched fatty alcohol, or an anteiso-branched hydrocarbon.

The chain length of a fatty acid, or a fatty acid derivative made therefrom, can be selected for by modifying the expression of certain thioesterases. Thioesterase influences the chain length of fatty acids produced as well as that of the derivatives made therefrom. Hence, the recombinant microbial cell can be engineered to express, overexpress, have attenuated expression, or not to express one or more selected thioesterases to increase the production of a preferred fatty acid or fatty acid derivative substrate. For example, $C_{10}$ fatty acids can be produced by expressing a thioesterase that has a preference for producing $C_{10}$ fatty acids and attenuating thioesterases that have a preference for producing fatty acids other than $C_{10}$ fatty acids (e.g., a thioesterase which prefers to produce $C_{14}$ fatty acids). This would result in a relatively homogeneous population of fatty acids that have a carbon chain length of 10. In other instances, $C_{14}$ fatty acids can be produced by attenuating endogenous thioesterases that produce non-$C_{14}$ fatty acids and expressing thioesterases that use $C_{14}$-ACP. In some situations, $C_{12}$ fatty acids can be produced by expressing thioesterases that use $C_{12}$-ACP and attenuating thioesterases that produce non-$C_{12}$ fatty acids. Fatty acid overproduction can be verified using methods known in the art, for example, by use of radioactive precursors, HPLC, or GC-MS subsequent to cell lysis.

Additional non-limiting examples of thioesterases and polynucleotides encoding them for use in the branched fatty acid pathway are provided in Table 6 and in PCT Publication No. WO 2010/075483 incorporated by reference herein.

Branched Fatty Ester

In one embodiment, the recombinant microbial cell produces a branched fatty ester (e.g., an anteiso-branched fatty ester or an iso-branched fatty ester), such as, for example, a branched fatty acid methyl ester or a branched fatty acid ethyl ester or a branched wax ester. In some embodiments, a branched fatty acid produced by the recombinant microbial cell is converted into the branched fatty ester.

In some embodiments, the recombinant microbial cell comprises a polynucleotide encoding a polypeptide (i.e., an enzyme) having ester synthase activity (also referred to herein as an "ester synthase polypeptide" or an "ester synthase enzyme"), and the branched fatty ester is produced by a reaction catalyzed by the ester synthase polypeptide expressed or overexpressed in the recombinant microbial cell. In some embodiments, a composition comprising branched fatty esters (also referred to herein as a "branched fatty ester composition"), produced by culturing the recombinant cell in the presence of a carbon source under conditions effective to express the polynucleotides, is recovered from the cell culture. In some embodiments, the recombinant cell produces a branched fatty ester composition comprising anteiso-branched fatty esters.

Ester synthase polypeptides include, for example, an ester synthase polypeptide classified as EC 2.3.1.75, or any other polypeptide which catalyzes the conversion of an acyl-thioester to a fatty ester, including, without limitation, a wax-ester synthase, an acyl-CoA:alcohol transacylase, an acyl-transferase, or a fatty acyl-CoA:fatty alcohol acyltransferase. For example, the polynucleotide may encode wax/dgat, a bifunctonal ester synthase/acyl-CoA:diacylglycerol acyl-transferase from *Simmondsia chinensis*, *Acinetobacter* sp. Strain ADP1, *Alcanivorax borkumensis*, *Pseudomonas aeruginosa*, *Fundibacter jadensis*, *Arabidopsis thaliana*, or

TABLE 6

Non-limiting examples of thioesterases and coding sequences thereof for use in the BCFA pathway shown in FIG. 1.

| EC number | Organism | Gene symbol | UniProtKB (Swiss-Prot) Protein Accession Number, or literature reference | NCBI Protein Accession Number | SEQ ID NO: pp, na |
|---|---|---|---|---|---|
| EC 3.1.2.—, | | | Thioesterase | | |
| | *E. coli* K-12 MG1655 | tesA | P0ADA1 | AAC73596 | 202, 203 |
| | *E. coli* (without leader sequence) | 'tesA | Cho et al, J. Biol. Chem., 270: 4216-4219 (1995) | | 204, 205 |
| | *E. coli* K-12 MG1655 | tesB | P0AGG2 | AAC73555 | 206, 207 |
| | *Arabidopsis thaliana* | fatA | Q42561 | NP_189147 | 208, 209 |
| | *Arabidopsis thaliana* | fatB | Q9SJE2 | NP_172327 | 210, 211 |
| | *Umbellularia california* | fatB | Q41635 | AAA34215 | 212, 213 |
| | *Cuphea hookeriana* | fatA1 | Q9ZTF7 | AAC72883 | 214, 215 |
| | *Cuphea hookeriana* | fatB2 | Q39514 | AAC49269 | 216, 217 |
| | *Cuphea hookeriana* | fatB3 | Q9ZTF9 | AAC72881 | 218, 219 |
| | *Cinnamonum camphorum* | fatB | Q39473 | AAC49151 | 220, 221 |
| | *Brassica juncea* | fatA | Q94IN9 | CAC39106 | 222, 223 |
| | *Helianthus annus* | fatA1 | Q6K1M5 | AAL79361 | 224, 225 |

*Alkaligenes eutrophus*. In a particular embodiment, the ester synthase polypeptide is an *Acinetobacter* sp. diacylglycerol O-acyltransferase (wax-dgaT; UniProtKB Q8GGG1, Gen-Bank AAO17391) or *Simmondsia chinensis* wax synthase (UniProtKB Q9XGY6, GenBank AAD38041). In a particular embodiment, the polynucleotide encoding the ester synthase polypeptide is overexpressed in the recombinant microbial cell. In some embodiments the recombinant microbial cell further comprises a polynucleotide encoding a thioesterase.

In another embodiment, the recombinant microbial cell produces a branched fatty ester, such as, for example, a branched fatty acid methyl ester or a branched fatty acid ethyl ester, wherein the recombinant microbial cell expresses a polynucleotide encoding an ester synthase/acyltransferase polypeptide classified as 2.3.1.20, such as AtfA1 (an acyltransferase derived from *Alcanivorax borkumensis* SK2, UniProtKB Q0VKV8, GenBank YP_694462) or AtfA2 (another acyltransferase derived from *Alcanivorax borkumensis* SK2, UniProtKB Q0VNJ6, GenBank YP_693524). In a particular embodiment, the polynucleotide encoding the ester synthase polypeptide is overexpressed in the recombinant microbial cell. In some embodiments the recombinant microbial cell further comprises a polynucleotide encoding a thioesterase.

In another embodiment, the recombinant microbial cell produces a branched fatty ester, such as, for example, a branched fatty acid methyl ester or a branched fatty acid ethyl ester, wherein the recombinant microbial cell expresses a polynucleotide encoding a ester synthase polypeptide, such as ES9 (a wax ester synthase from *Marinobacter hydrocarbonoclasticus* DSM 8798, UniProtKB A3RE51, GenBank AB021021, encoded by the ws2 gene), or ES376 (another wax ester synthase derived from *Marinobacter hydrocarbonoclasticus* DSM 8798, UniProtKB A3RE50, GenBank AB021020, encoded by the ws2 gene). In a particular embodiment, the polynucleotide encoding the ester synthase polypeptide is overexpressed in the recombinant microbial cell. In some embodiments the recombinant microbial cell further comprises a polynucleotide encoding a thioesterase.

Additional non-limiting examples of ester synthase polypeptides and polynucleotides encoding them suitable for use in these embodiments include those described in PCT Publication Nos. WO 2007/136762 and WO2008/119082 which are incorporated by reference herein.

Branched Fatty Aldehyde

In one embodiment, the recombinant microbial cell produces a branched fatty aldehyde. In some embodiments, a branched fatty acid produced by the recombinant microbial cell is converted into the branched fatty aldehyde. In some embodiments, the branched fatty aldehyde produced by the recombinant microbial cell is then converted into a branched fatty alcohol or a branched hydrocarbon.

In some embodiments, the recombinant microbial cell comprises a polynucleotide encoding a polypeptide (i.e., an enzyme) having fatty aldehyde biosynthesis activity (also referred to herein as a "fatty aldehyde biosynthesis polypeptide" or a "fatty aldehyde biosynthesis enzyme"), and the branched fatty aldehyde is produced by a reaction catalyzed by the fatty aldehyde biosynthesis polypeptide expressed or overexpressed in the recombinant microbial cell. In some embodiments, a composition comprising branched fatty aldehydes (also referred to herein as a "branched fatty aldehyde composition"), produced by culturing the recombinant cell in the presence of a carbon source under conditions effective to express the polynucleotides, is recovered from the cell culture. In some embodiments, the recombinant cell produces a branched fatty aldehyde composition comprising anteiso-branched fatty aldehydes.

In some embodiments, the branched fatty aldehyde is produced by expressing or overexpressing in the recombinant microbial cell a polynucleotide encoding a polypeptide having a fatty aldehyde biosynthesis activity such as carboxylic acid reductase (CAR) activity (encoded, for example, by a car gene). Examples of carboxylic acid reductase (CAR) polypeptides and polynucleotides encoding them useful in accordance with this embodiment include, but are not limited to, FadD9 (EC 6.2.1.-, UniProtKB O50631, GenBank NP_217106), CarA (GenBank ABK75684), CarB (GenBank YP889972) and related polypeptides described in PCT Publication No. WO 2010/062480 which is incorporated by reference herein. In some embodiments the recombinant microbial cell further comprises a polynucleotide encoding a thioesterase.

In some embodiments, the branched fatty aldehyde is produced by expressing or overexpressing in the recombinant microbial cell a polynucleotide encoding a fatty aldehyde biosynthesis polypeptide, such as a polypeptide having acyl-ACP reductase (AAR) activity, encoded by, for example, an oar gene. Examples of acyl-ACP reductase polypeptides useful in accordance with this embodiment include, but are not limited to, acyl-ACP reductase from *Synechococcus elongatus* PCC 7942 (GenBank YP_400611) and related polypeptides described in PCT Publication No. WO 2010/042664 which is incorporated by reference herein.

In some embodiments, the branched fatty aldehyde is produced by expressing or overexpressing in the recombinant microbial cell a polynucleotide encoding a fatty aldehyde biosynthesis polypeptide, such as a polypeptide having acyl-CoA reductase activity (e.g., EC 1.2.1.x), encoded by, for example, an acr1 gene. Examples of acyl-CoA reductase polypeptides useful in accordance with this embodiment include, but are not limited to, ACR1 from *Acinetobacter* sp. strain ADP1 (GenBank YP_047869) and related polypeptides described in PCT Publication No. WO 2010/042664 which is incorporated by reference herein. In some embodiments the recombinant microbial cell further comprises polynucleotides encoding a thioesterase and an acyl-CoA synthase.

Branched Fatty Alcohol

In one embodiment, the recombinant microbial cell produces a branched fatty alcohol (e.g., an anteiso-branched fatty alcohol or an iso-branched fatty alcohol). In some embodiments, a branched fatty aldehyde produced by the recombinant microbial cell is converted to the branched fatty alcohol.

In some embodiments, the recombinant microbial cell comprises a polynucleotide encoding a polypeptide (i.e., an enzyme) having fatty alcohol biosynthesis activity (also referred to herein as a "fatty alcohol biosynthesis polypeptide" or a "fatty alcohol biosynthesis enzyme"), and the branched fatty alcohol is produced by a reaction catalyzed by the fatty alcohol biosynthesis enzyme expressed or overexpressed in the recombinant microbial cell. In some embodiments, a composition comprising branched fatty alcohols (also referred to herein as a "branched fatty alcohol composition"), produced by culturing the recombinant cell in the presence of a carbon source under conditions effective to express the polynucleotides, is recovered from the cell culture. In some embodiments, the recombinant cell produces a branched fatty alcohol composition comprising anteiso-branched fatty alcohols.

In some embodiments, the branched fatty alcohol is produced by expressing or overexpressing in the recombinant microbial cell a polynucleotide encoding a polypeptide having fatty alcohol biosynthesis activity such as alcohol dehydrogenase (aldehyde reductase) activity, e.g., EC 1.1.1.1. Examples of alcohol dehydrogenase polypeptides useful in accordance with this embodiment include, but are not limited to, *E. coli* alcohol dehydrogenase YqhD (GenBank AP_003562) and related polypeptides described in PCT Publication Nos. WO 2007/136762 and WO2008/119082 which are incorporated by reference herein. In some embodiments the recombinant microbial cell further comprises a polynucleotide encoding a fatty aldehyde biosynthesis polypeptide. In some embodiments the recombinant microbial cell further comprises a polynucleotide encoding a thioesterase.

In some embodiments, the branched fatty alcohol is produced by expressing or overexpressing in the recombinant microbial cell a polynucleotide encoding a fatty alcohol biosynthesis polypeptide, such as a polypeptide having fatty alcohol forming acyl-CoA reductase (FAR) activity, e.g., EC 1.1.1.x. Examples of FAR polypeptides useful in accordance with this embodiment include, but are not limited to, those described in PCT Publication No. WO 2010/062480 which is incorporated by reference herein. In some embodiments the recombinant microbial cell further comprises polynucleotides encoding a thioesterase and an acyl-CoA synthase.

Branched Hydrocarbon

In one embodiment, the recombinant microbial cell produces a branched hydrocarbon (e.g., an anteiso-branched hydrocarbon or an iso-branched hydrocarbon), such as a branched alkane or a branched alkene (e.g., a branched terminal olefin or a branched internal olefin). In some embodiments, a branched fatty aldehyde produced by the recombinant microbial cell is converted into the branched hydrocarbon.

In some embodiments, the recombinant microbial cell comprises a polynucleotide encoding a polypeptide (i.e., an enzyme) having hydrocarbon biosynthesis activity (also referred to herein as a "hydrocarbon biosynthesis polypeptide" or a "hydrocarbon biosynthesis enzyme"), and the branched hydrocarbon is produced by a reaction catalyzed by the hydrocarbon biosynthesis enzyme expressed or overexpressed in the recombinant microbial cell. In some embodiments, a composition comprising branched hydrocarbons (also referred to herein as a "branched hydrocarbon composition"), produced by culturing the recombinant cell in the presence of a carbon source under conditions effective to express the polynucleotides, is recovered from the cell culture. In some embodiments, the recombinant cell produces a branched hydrocarbon composition comprising anteiso-branched fatty hydrocarbons.

In some embodiments, the branched hydrocarbon is produced by expressing or overexpressing in the recombinant microbial cell a polynucleotide encoding a polypeptide having hydrocarbon biosynthesis activity such as an aldehyde decarbonylase (ADC) activity (e.g., EC 4.1.99.5), for example, a polynucleotide encoding an aldehyde decarbonylase from *Prochlorococcus marinus* MIT9313 (GenBank NP_895059). Additional examples of aldehyde decarbonylase and related polypeptides useful in accordance with this embodiment include, but are not limited to, those described in PCT Publication Nos. WO 2007/136762 and WO2008/119082 which are incorporated by reference herein. In some embodiments the recombinant microbial cell further comprises a polynucleotide encoding a fatty aldehyde biosynthesis polypeptide. In some embodiments the recombinant microbial cell further comprises a polynucleotide encoding an acyl-ACP reductase.

In some embodiments, a branched terminal olefin is produced by expressing or overexpressing in the recombinant microbial cell a polynucleotide encoding a hydrocarbon biosynthesis polypeptide, such as a polypeptide having decarboxylase activity as described, for example, in PCT Publication No. 2009/085278 which is incorporated by reference herein. In some embodiments the recombinant microbial cell further comprises a polynucleotide encoding a thioesterase.

In some embodiments, a branched internal olefin is produced by expressing or overexpressing in the recombinant microbial cell a polynucleotide encoding a hydrocarbon biosynthesis polypeptide, such as a polypeptide having OleCD or OleBCD activity as described, for example, in PCT Publication No. WO 2008/147781 which is incorporated by reference herein. In some embodiments the recombinant microbial cell further comprises a polynucleotide encoding a thioesterase and an acyl-CoA synthase.

Saturation Levels of Branched Fatty Acid Derivatives

The degree of saturation of branched acyl-ACPs (which can then be converted into various branched fatty acid derivatives as described hereinabove) can be controlled by regulating the degree of saturation of fatty acid intermediates. For example, the sfa, gns, and fab families of genes can be expressed, overexpressed, or expressed at reduced levels (e.g., attenuated), to control the amount of saturation of a branched acyl-ACP.

BCFA Pathway Polypeptides and Polynucleotides

The disclosure identifies polynucleotides useful in the recombinant microbial cells, methods, and compositions of the invention; however it will be recognized that absolute sequence identity to such polynucleotides is not necessary. For example, changes in a particular polynucleotide sequence can be made and the encoded polypeptide screened for activity. Such changes typically comprise conservative mutations and silent mutations (such as, for example, codon optimization). Modified or mutated (i.e., mutant) polynucleotides and encoded variant polypeptides can be screened for a desired function, such as, an improved function compared to the parent polypeptide, including but not limited to increased catalytic activity, increased stability, or decreased inhibition (e.g., decreased feedback inhibition), using methods known in the art.

The disclosure identifies enzymatic activities involved in various steps (i.e., reactions) of the BCFA biosynthetic pathways described herein according to Enzyme Classification (EC) number, and provides exemplary polypeptides (i.e., enzymes) categorized by such EC numbers, and exemplary polynucleotides encoding such polypeptides. Such exemplary polypeptides and polynucleotides, which are identified herein by Accession Numbers and/or Sequence Identifier Numbers (SEQ ID NOs), are useful for engineering BCFA pathways in parental microbial cells to obtain the recombinant microbial cells described herein. It is to be understood, however, that polypeptides and polynucleotides described herein are exemplary and non-limiting. The sequences of homologues of representative polypeptides described herein are available to those of skill in the art using databases such as, for example, the Entrez databases provided by the National Center for Biotechnology Information (NCBI), the ExPasy databases provided by the Swiss Institute of Bioinformatics, and the KEGG database provided by the Bioinformatics Center of Kyoto University and University of Tokyo, all which are available on the World Wide Web.

It is to be further understood that a variety of microbial cells can be modified to contain a BCFA pathway described herein, resulting in recombinant microbial cells suitable for the production of branched chain fatty acid derivatives. It is also understood that a variety of cells can provide sources of genetic material, including sequences of polynucleotides encoding polypeptides suitable for use in a recombinant microbial cell provided herein.

The disclosure provides numerous examples of polypeptides (i.e., enzymes) having activities suitable for use in the BCFA biosynthetic pathways described herein. Such polypeptides are collectively referred to herein as "BCFA pathway polypeptides" (alternatively, "BCFA pathway enzymes"). Non-limiting examples of BCFA pathway polypeptides suitable for use in recombinant microbial cells of the invention are provided in the Tables and Description and in the Examples herein.

In some embodiments, the invention includes a recombinant microbial cell comprising a polynucleotide sequence (also referred to herein as a "BCFA pathway polynucleotide" sequence) which encodes a BCFA pathway polypeptide.

Additional BCFA pathway polypeptides and polynucleotides encoding them suitable for use in engineering a BCFA pathway in a recombinant microbial cell of the invention can be obtained by a number of methods.

For example, EC numbers classify enzymes according to the reaction catalyzed. Enzymes that catalyze a reaction in a biosynthetic pathway described herein can be identified by searching the EC number corresponding to that reaction in a database such as, for example: the KEGG database (Kyoto Encyclopedia of Genes and Genomes; Kyoto University and University of Tokyo); the UNIPROTKB database or the ENZYME database (ExPASy Proteomics Server; Swiss Institute of Bioinformatics); the PROTEIN database or the GENE database (Entrez databases; National Center for Biotechnology Information (NCBI)); or the BRENDA database (The Comprehensive Enzyme Information System; Technical University of Braunschweig); all of which are available on the World Wide Web. In one embodiment, a BCFA pathway polynucleotide encoding a BCFA pathway polypeptide having an enzymatic activity categorized by an EC number (such as, an EC number listed in the Description or in one of Tables herein), or a fragment or a variant thereof having that activity, is used in engineering the corresponding step of a BCFA pathway in a recombinant microbial cell.

In some embodiments, a BCFA pathway polynucleotide sequence encodes a polypeptide which is endogenous to the parental cell of the recombinant cell being engineered. Some such endogenous polypeptides are overexpressed in the recombinant microbial cell. An "endogenous polypeptide", as used herein, refers to a polypeptide which is encoded by the genome of the parental (e.g, wild-type) cell that is being engineered to produce the recombinant microbial cell.

A BCFA pathway polypeptide, such as for example an endogenous BCFA pathway polypeptide, can be overexpressed by any suitable means. As used herein, "overexpress" means to express or cause to be expressed a polynucleotide or polypeptide in a cell at a greater concentration than is normally expressed in a corresponding parental (for example, wild-type) cell under the same conditions. For example, a polypeptide is "overexpressed" in a recombinant microbial cell when it is present in a greater concentration in the recombinant cell as compared to its concentration in a non-recombinant host cell of the same species (e.g., the parental cell) when cultured under the same conditions.

In some embodiments, the BCFA pathway polynucleotide sequence encodes an exogenous or heterologous polypeptide. In other words, the polypeptide encoded by the polynucleotide is exogenous to the parental microbial cell. An "exogenous" (or "heterologous") polypeptide, as used herein, refers to a polypeptide not encoded by the genome of the parental (e.g, wild-type) microbial cell that is being engineered to produce the recombinant microbial cell. Such a polypeptide can also be referred to as a "non-native" polypeptide. A variant (that is, a mutant) polypeptide is an example of an exogenous polypeptide.

In certain embodiments, a BCFA pathway polypeptide comprises an amino acid sequence other than that of one of the exemplary polypeptides provided herein; for example, the BCFA pathway polypeptide can comprise a sequence which is a homologue, a fragment, or a variant of the sequence of the exemplary polypeptide.

The terms "homolog," "homologue," and "homologous" as used herein refer to a polynucleotide or a polypeptide comprising a sequence that is at least 50%, preferably at least 60%, more preferably at least 70% (e.g., at least 75%, at least 80%, at least 85%, at least 90%, at least 91%, at least 92%, at least 93%, at least 94%, at least 95%, at least 96%, at least 97%, at least 98%, or at least 99%) homologous to the corresponding polynucleotide or polypeptide sequence. One of ordinary skill in the art is well aware of methods to determine homology between two or more sequences. Briefly, calculations of "homology" between two sequences can be performed as follows. The sequences are aligned for optimal comparison purposes (e.g., gaps can be introduced in one or both of a first and a second amino acid or polynucleotide sequence for optimal alignment and non-homologous sequences can be disregarded for comparison purposes). In a preferred embodiment, the length of a first sequence that is aligned for comparison purposes is at least about 30%, preferably at least about 40%, more preferably at least about 50%, even more preferably at least about 60%, and even more preferably at least about 70%, at least about 80%, at least about 90%, or about 100% of the length of a second sequence. The amino acid residues or nucleotides at corresponding amino acid positions or nucleotide positions of the first and second sequences are then compared. When a position in the first sequence is occupied by the same amino acid residue or nucleotide as the corresponding position in the second sequence, then the molecules are identical at that position (as used herein, amino acid or nucleic acid "identity" is equivalent to amino acid or nucleic acid "homology"). The percent identity between the two sequences is a function of the number of identical positions shared by the sequences, taking into account the number of gaps and the length of each gap, which need to be introduced for optimal alignment of the two sequences.

The comparison of sequences and determination of percent homology (i.e., percent identity) between two sequences can be accomplished using a mathematical algorithm, such as BLAST (Altschul et al., *J. Mol. Biol.*, 215(3): 403-410 (1990)). The percent homology between two amino acid sequences also can be determined using the Needleman and Wunsch algorithm that has been incorporated into the GAP program in the GCG software package, using either a Blossum 62 matrix or a PAM250 matrix, and a gap weight of 16, 14, 12, 10, 8, 6, or 4 and a length weight of 1, 2, 3, 4, 5, or 6 (Needleman and Wunsch, *J. Mol. Biol.*, 48: 444-453 (1970)). The percent homology between two nucleotide sequences also can be determined using the GAP program in the GCG software package, using a NWSgapdna.CMP matrix and a gap weight of 40, 50, 60, 70, or 80 and a length weight of 1, 2, 3, 4, 5, or 6. One of ordinary skill in the art can perform initial homology calculations and adjust the algorithm parameters accordingly. A preferred set of parameters (and the one that should be used if a practitioner is uncertain about which parameters should be applied to determine if a molecule is within a homology limitation of the claims) are a Blossum 62 scoring matrix with a gap penalty of 12, a gap extend penalty of 4, and a frameshift gap penalty of 5. Additional methods of sequence alignment are known in the biotechnology arts (see, e.g., Rosenberg, *BMC Bioinformatics,* 6: 278 (2005); Altschul et al., *FEBS J.,* 272(20): 5101-5109 (2005)).

An "equivalent position" (for example, an "equivalent amino acid position" or "equivalent nucleic acid position") is defined herein as a position (such as, an amino acid position or nucleic acid position) of a test polypeptide (or test polynucleotide) sequence which aligns with a corresponding position of a reference polypeptide (or reference polynucleotide) sequence, when optimally aligned using an alignment algorithm as described herein. The equivalent amino acid position of the test polypeptide need not have the same numerical position number as the corresponding position of the reference polypeptide; likewise, the equivalent nucleic acid position of the test polynucleotide need not have the same numerical position number as the corresponding position of the reference polynucleotide.

In some embodiments, the BCFA pathway polypeptide is a variant of a reference (e.g., a parent) polypeptide, such as a variant of an exemplary BCFA pathway polypeptide described herein. A "variant" (alternatively, "mutant") polypeptide as used herein refers to a polypeptide having an amino acid sequence that differs from that of a parent (e.g., wild-type) polypeptide by at least one amino acid. The variant can comprise one or more conservative amino acid substitutions, and/or can comprise one or more non-conservative substitutions, compared to the parent polypeptide sequence. In some embodiments, the variant polypeptide has 1, 2, 3, 4, 5, 6, 7, 8, 9, 10, 15, 20, 30, 40, 50, or more amino acid substitutions, additions, insertions, or deletions compared to the parent polypeptide sequence. In some embodiments, the sequence of the variant polypeptide is at least 80%, at least 85%, at least 90%, at least 91%, at least 92%, at least 93%, at least 94%, at least 95%, at least 96%, at least 97%, at least 98%, or at least 99% identical to the sequence of the parent polypeptide.

In some embodiments, the BCFA pathway polypeptide is a fragment of a reference (e.g., a parent) polypeptide, such as a fragment of an exemplary BCFA pathway polypeptide described herein. The term "fragment" refers to a shorter portion of a full-length polypeptide or protein ranging in size from four amino acid residues to the entire amino acid sequence minus one amino acid residue. In certain embodiments of the invention, a fragment refers to the entire amino acid sequence of a domain of a polypeptide or protein (e.g., a substrate binding domain or a catalytic domain).

In some embodiments, a homologue, a variant, or a fragment further comprises one or more sequence motifs as defined herein. In one embodiment, a homologue, a variant, or a fragment of a branched chain alpha-keto acid dehydrogenase E1-alpha subunit polypeptide further comprises one or more sequence motifs selected from SEQ ID NOs: 15-21. In another embodiment, a homologue, a variant, or a fragment of a branched chain alpha-keto acid dehydrogenase E1-beta subunit polypeptide further comprises one or more sequence motifs selected from SEQ ID NOs: 36-42. In another embodiment, a homologue, a variant, or a fragment of a lipoamide acyltransferase polypeptide further comprises one or more sequence motifs selected from SEQ ID NOs: 57-62. In another embodiment, a homologue, a variant, or a fragment of a dihydrolipoyl dehydrogenase polypeptide further comprises one or more sequence motifs selected from SEQ ID NOs: 79-83. In another embodiment, a homologue, a variant, or a fragment of a beta-ketoacyl-ACP synthase III polypeptide further comprises one or more sequence motifs selected from SEQ ID NOs:110-115. Determination that a sequence contains a particular sequence motif can be readily accomplished, for example, using the ScanProsite tool available on the World Wide Web site of the ExPASy Proteomics Server.

It is understood that a BCFA polypeptide may have conservative or non-essential amino acid substitutions, relative to a parent polypeptide, which does not have a substantial effect on a biological function or property of the BCFA polypeptide. Whether or not a particular substitution will be tolerated (i.e., will not adversely affect a desired biological function, such as enzymatic activity) can be determined, for example, as described in Bowie et al. (*Science,* 247: 1306-1310 (1990)).

A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid); uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine), and aromatic side chains (e.g., tyrosine, phenylalanine, tryptophan, histidine).

Variants can be naturally occurring or created in vitro. In particular, variants can be created using genetic engineering techniques, such as site directed mutagenesis, random chemical mutagenesis, exonuclease III deletion procedures, or standard cloning techniques. Alternatively, such variants, fragments, analogs, or derivatives can be created using chemical synthesis or modification procedures.

Methods of making variants are well known in the art. These include procedures in which nucleic acid sequences obtained from natural isolates are modified to generate nucleic acids that encode polypeptides having characteristics that enhance their value in industrial or laboratory applications (including, but not limited to, increased catalytic activity (turnover number), improved stability, and reduced feedback inhibition). In such procedures, a large number of modified nucleic acid sequences having one or more nucleotide differences with respect to the sequence obtained from the natural isolate are generated and characterized. Typically, these nucleotide differences result in amino acid changes with respect to the polypeptides encoded by the nucleic acids from the natural isolates. For example, variants can be prepared by using random or site-directed mutagenesis.

Variants can also be created by in vivo mutagenesis. In some embodiments, random mutations in a nucleic acid sequence are generated by propagating the sequence in a bacterial strain, such as an *E. coli* strain, which carries mutations in one or more of the DNA repair pathways. Such "mutator" strains have a higher random mutation rate than that of a wild-type strain. Propagating a DNA sequence in one of these strains will eventually generate random mutations within the DNA. Mutator strains suitable for use for in vivo mutagenesis are described in, for example, International Patent Application Publication No. WO 1991/016427.

Variants can also be generated using cassette mutagenesis. In cassette mutagenesis, a small region of a double-stranded DNA molecule is replaced with a synthetic oligonucleotide "cassette" that differs from the native sequence. The oligonucleotide often contains a completely and/or partially randomized native sequence.

Recursive ensemble mutagenesis can also be used to generate variants. Recursive ensemble mutagenesis is an algorithm for protein engineering (i.e., protein mutagenesis)

developed to produce diverse populations of phenotypically related mutants whose members differ in amino acid sequence. This method uses a feedback mechanism to control successive rounds of combinatorial cassette mutagenesis. Recursive ensemble mutagenesis is described in, for example, Arkin et al., *Proc. Natl. Acad. Sci., U.S.A.,* 89: 7811-7815 (1992).

In some embodiments, variants are created using exponential ensemble mutagenesis. Exponential ensemble mutagenesis is a process for generating combinatorial libraries with a high percentage of unique and functional mutants, wherein small groups of residues are randomized in parallel to identify, at each altered position, amino acids which lead to functional proteins. Exponential ensemble mutagenesis is described in, for example, Delegrave et al., *Biotech. Res,* 11: 1548-1552 (1993).

Preferred fragments or variants of a parent polypeptide (e.g., fragments or variants of a parent BCFA pathway polypeptide) retain some or all of a biological function or property (such as, enzymatic activity, thermal stability) of the parent polypeptide. In some embodiments, the fragment or variant retains at least 75% (e.g., at least 80%, at least 90%, or at least 95%) of a biological function or property of the parent polypeptide. In other embodiments, the fragment or variant retains about 100% of a biological function or property of the parent polypeptide.

In some embodiments, the fragment or variant of the parent polypeptide exhibits an increased catalytic activity (as reflected by, for example, a higher turnover number, an altered pH optimum, or a decreased $K_m$ for a desired substrate), relative to that of the parent polypeptide, under conditions in which the recombinant microbial cell is cultured. For example, if the parent polypeptide is endogenous to (that is, is derived from) a thermophilic cell, and if the recombinant microbial cell is generally cultured at a lower temperature than the thermophilic cell, the parent polypeptide may exhibit significantly reduced activity at the lower temperature; in which case, the variant polypeptide preferably exhibits an increased catalytic activity (such as, a higher turnover number), relative to that of the parent polypeptide, at that lower temperature.

In other embodiments, the fragment or variant of the parent polypeptide exhibits improved stability, relative to that of the parent polypeptide, under conditions in which the recombinant microbial cell is cultured. Such stability can include stability towards changes in temperature, ionic strength, pH, or any other differences in growth or media conditions between the recombinant microbial cell and the cell from which the parent polypeptide was derived. For example, if the parent polypeptide is derived from a psychrotrophic cell, and if the recombinant microbial cell is generally cultured at a higher temperature than the psychrotrophic cell, the parent polypeptide may be relatively unstable at the higher temperature; in which case, the variant polypeptide preferably exhibits improved stability relative to that of the parent polypeptide at that higher temperature.

In other embodiments, the fragment or variant of the parent polypeptide exhibits reduced inhibition of catalytic activity (such as, reduced feedback inhibition) by a cellular metabolite or by a culture media component, relative to such inhibition exhibited by the parent polypeptide, under conditions in which the recombinant microbial cell is cultured.

In certain embodiments, a BCFA pathway polypeptide is a homologue, a fragment, or a variant of a parent polypeptide, wherein the BCFA pathway polypeptide is effective in carrying out a BCFA pathway reaction in a recombinant microbial cell. Such a BCFA pathway polypeptide is suitable for use in a recombinant microbial cell of the invention.

The effectiveness of a test polypeptide (such as, for example, a BCFA pathway polypeptide described herein, or a homologue, a fragment, or a variant thereof) in carrying out a reaction of a BCFA pathway can be determined by a number of methods. For example, to determine the effectiveness of a test polypeptide in catalyzing a specific reaction of a biochemical pathway, first a host cell is engineered to obtain a parental cell that comprises all the activities necessary to catalyze the reactions of the biochemical pathway in question, except for the specific pathway reaction being tested (although, in some instances, the parental cell may express endogenous polypeptide(s) that catalyze the specific pathway reaction being tested; in such instances the endogenous activity will preferably be low enough to readily detect an increase in product owing to the activity of the test polypeptide). A polynucleotide encoding the test polypeptide, operatively linked to a suitable promoter (e.g., in an expression vector), is then introduced into the parental cell, generating a test cell. The test cell and the parental cell are cultured separately under identical conditions which are sufficient for expression of the pathway polypeptides in the parental and test cell cultures and expression of the test polypeptide in the test cell culture. At various times during and/or after culturing, samples are obtained from the test cell culture and the parental cell culture. The samples are analyzed for the presence of a particular pathway intermediate or product. Presence of the pathway intermediate or product can be determined by methods including, but not limited to, gas chromatography (GC), mass spectroscopy (MS), thin layer chromatography (TLC), high-performance liquid chromatography (HPLC), liquid chromatography (LC), GC coupled with a flame ionization detector (FID), GC-MS, and LC-MS. Example 11 herein provides methods of analyzing culture samples for the presence of a BCFA pathway intermediate or product, such as a branched fatty acid, a branched fatty alcohol, a branched fatty ester or a branched hydrocarbon. The presence of a BCFA pathway intermediate or product in the test cell culture sample(s), and the absence (or a reduced amount) of the BCFA pathway intermediate or product in the parent cell culture sample(s), indicates that the test polypeptide is effective in carrying out a BCFA pathway reaction and is suitable for use in a recombinant microbial cell of the invention.

Production of Branched Fatty Acid Derivatives in Recombinant Microbial Cells

In one aspect, the invention includes a method of making a branched fatty acid derivative composition, the method comprising culturing a recombinant microbial cell of the invention in a culture medium containing a carbon source under conditions effective to express the recombinant polynucleotide sequences, and optionally isolating the produced branched fatty acid derivative composition.

A "branched fatty acid derivative composition" is a composition comprising a branched fatty acid derivative as defined herein, such as, for example, a branched fatty acid, a branched fatty ester (e.g., a branched fatty methyl ester, a branched fatty ethyl ester, a branched wax ester), a branched fatty aldehyde, a branched fatty alcohol, a branched hydrocarbon (such as a branched alkane, a branched alkene, a branched terminal olefin, a branched internal olefin), or a branched ketone. Similarly, a "branched fatty acid composition" is a composition comprising a branched fatty acid, and so on.

In one aspect, the invention includes a method of making a composition comprising a branched fatty acid derivative, the method comprising: obtaining a recombinant microbial cell (such as, a culture comprising a recombinant microbial cell) comprising: (a) polynucleotides encoding a branched chain alpha-keto acid dehydrogenase (BKD) complex, comprising polypeptides having branched-chain alpha-keto acid dehydrogenase activity, lipoamide acyltransferase activity, and dihydrolipoamide dehydrogenase activity, and (b) a polynucleotide encoding a polypeptide having beta-ketoacyl-ACP synthase activity that utilizes a branched acyl-CoA molecule as a substrate, wherein at least one polynucleotide according to (a) or (b) encodes a polypeptide that is exogenous to the parental microbial cell or expression of said polynucleotide is modulated in the recombinant microbial cell; the recombinant microbial cell further comprising one or more polynucleotides each which encodes a polypeptide having fatty acid derivative enzyme activity, wherein the recombinant microbial cell produces a branched chain fatty acid derivative when cultured in the presence of a carbon source under conditions effective to express the polynucleotides; culturing the recombinant microbial cell in a culture medium containing a carbon source under conditions effective to express the polynucleotides and produce a fatty acid derivative composition comprising straight-chain fatty acid derivatives and branched fatty acid derivatives, the branched fatty acid derivatives comprising iso-branched fatty acid derivatives and/or anteiso-branched fatty acid derivatives; and optionally recovering the composition from the culture medium.

In some embodiments, the fatty acid derivative composition produced by the recombinant cell comprises branched fatty acid derivatives, wherein at least 10%, at least 20%, at least 30%, at least 40%, at least 50%, at least 60%, at least 70%, at least 80% or at least 90% by weight of the fatty acid derivatives in the composition are branched fatty acid derivatives. In some embodiments, the fatty acid derivative composition comprises branched fatty acid derivatives in an amount (e.g., a titer) of at least 10 mg/L, at least 15 mg/L, at least 20 mg/L, at least 25 mg/L, at least 50 mg/L, at least 75 mg/L, at least 100 mg/L, at least 125 mg/L, at least 150 mg/L, at least 175 mg/L, at least 200 mg/L, at least 225 mg/L, at least 250 mg/L, at least 275 mg/L, at least 300 mg/L, at least 325 mg/L, at least 350 mg/L, at least 375 mg/L, at least 400 mg/L, at least 425 mg/L, at least 450 mg/L, at least 475 mg/L, at least 500 mg/L, at least 525 mg/L, at least 550 mg/L, at least 575 mg/L, at least 600 mg/L, at least 625 mg/L, at least 650 mg/L, at least 675 mg/L, at least 700 mg/L, at least 725 mg/L, at least 750 mg/L, at least 775 mg/L, at least 800 mg/L, at least 825 mg/L, at least 850 mg/L, at least 875 mg/L, at least 900 mg/L, at least 925 mg/L, at least 950 mg/L, at least 975 mg/L, at least 1000 mg/L, at least 1050 mg/L, at least 1075 mg/L, at least 1100 mg/L, at least 1125 mg/L, at least 1150 mg/L, at least 1175 mg/L, at least 1200 mg/L, at least 1225 mg/L, at least 1250 mg/L, at least 1275 mg/L, at least 1300 mg/L, at least 1325 mg/L, at least 1350 mg/L, at least 1375 mg/L, at least 1400 mg/L, at least 1425 mg/L, at least 1450 mg/L, at least 1475 mg/L, at least 1500 mg/L, at least 1525 mg/L, at least 1550 mg/L, at least 1575 mg/L, at least 1600 mg/L, at least 1625 mg/L, at least 1650 mg/L, at least 1675 mg/L, at least 1700 mg/L, at least 1725 mg/L, at least 1750 mg/L, at least 1775 mg/L, at least 1800 mg/L, at least 1825 mg/L, at least 1850 mg/L, at least 1875 mg/L, at least 1900 mg/L, at least 1925 mg/L, at least 1950 mg/L, at least 1975 mg/L, at least 2000 mg/L, or a range bounded by any two of the foregoing values.

In various embodiments, the fatty acid derivative enzyme activity comprises a thioesterase activity, an ester synthase activity, a fatty aldehyde biosynthesis activity, a fatty alcohol biosynthesis activity, a ketone biosynthesis activity, and/or a hydrocarbon biosynthesis activity. In some embodiments, the recombinant microbial cell comprises polynucleotides encoding two or more polypeptides, each polypeptide having a fatty acid derivative enzyme activity.

In various embodiments, the one or more polypeptides having fatty acid derivative enzyme activity as described hereinabove, wherein the recombinant microbial cell produces a composition comprising branched fatty acids, branched fatty esters, branched wax esters, branched fatty aldehydes, branched fatty alcohols, branched alkanes, branched alkenes, branched internal olefins, branched terminal olefins, or branched ketones.

In another aspect, the invention includes a method of making a composition comprising an anteiso-branched fatty acid derivative, the method comprising: obtaining a recombinant microbial cell (such as, a culture comprising a recombinant microbial cell) comprising: (a) polynucleotides encoding a branched chain alpha-keto acid dehydrogenase (BKD) complex, comprising polypeptides having branched-chain alpha-keto acid dehydrogenase activity, lipoamide acyltransferase activity, and dihydrolipoamide dehydrogenase activity, and (b) a polynucleotide encoding a polypeptide having beta-ketoacyl-ACP synthase activity that utilizes a branched acyl-CoA molecule as a substrate; and further comprising (c) polynucleotides encoding polypeptides having aspartokinase activity, homoserine dehydrogenase activity, homoserine kinase activity, threonine synthase activity, and threonine deaminase activity, or (d) polynucleotides encoding polypeptides having (R)-citramalate synthase activity, isopropylmalate isomerase activity, and beta-isopropyl malate dehydrogenase activity, or (c) and (d); and (e) polypeptides having acetohydroxyacid synthase activity, acetohydroxyacid isomeroreductase activity, and dihydroxy acid dehydratase activity; wherein at least one polynucleotide according to (a), (b), (c), (d), or (e) encodes a polypeptide that is exogenous to the recombinant microbial cell or expression of said polynucleotide is modulated in the recombinant microbial cell; the recombinant microbial cell further comprising one or more polynucleotides each which encodes a polypeptide having fatty acid derivative enzyme activity, wherein the recombinant microbial cell produces an anteiso-branched chain fatty acid derivative when cultured in the presence of a carbon source under conditions effective to express the polynucleotides; culturing the recombinant microbial cell in a culture medium containing a carbon source under conditions effective to express the polynucleotides and produce a fatty acid derivative composition comprising straight-chain fatty acid derivatives and branched fatty acid derivatives, the branched fatty acid derivatives comprising anteiso-branched fatty acid derivatives; and optionally recovering the composition from the culture medium.

In some embodiments, the fatty acid derivative composition produced by the recombinant microbial cell culture comprises anteiso-branched fatty acid derivatives, wherein at least 10%, at least 20%, at least 30%, at least 40%, at least 50%, at least 60%, at least 70%, or at least 80% by weight of the branched fatty acid derivatives in the composition are anteiso-branched fatty acid derivatives. In some embodiments, the fatty acid derivative composition comprises anteiso-branched fatty acid derivatives in an amount (e.g., a titer) of at least 10 mg/L, at least 15 mg/L, at least 20 mg/L, at least 25 mg/L, at least 50 mg/L, at least 75 mg/L, at least 100 mg/L, at least 125 mg/L, at least 150 mg/L, at least 175 mg/L, at least 200 mg/L, at least 225 mg/L, at least 250 mg/L, at least 275 mg/L, at least 300 mg/L, at least 325 mg/L, at least 350 mg/L, at least 375 mg/L, at least 400 mg/L, at least 425 mg/L, at least 450 mg/L, at least 475 mg/L, at least 500 mg/L, at least 525 mg/L, at least 550 mg/L, at least 575 mg/L, at least 600 mg/L, at least 625 mg/L, at least 650 mg/L, at least 675 mg/L, at least 700 mg/L, at least 725 mg/L, at least 750 mg/L, at least 775 mg/L, at least 800 mg/L, at least 825 mg/L, at least 850 mg/L, at least 875 mg/L, at least 900 mg/L, at least 925 mg/L, at least 950 mg/L, at least 975 mg/L, at least 1000 mg/L, at least 1050 mg/L, at least 1075 mg/L, at least 1100 mg/L, at least 1125 mg/L, at least 1150 mg/L, at least 1175 mg/L, at least 1200 mg/L, at least 1225 mg/L, at least 1250 mg/L, at least 1275 mg/L, at least 1300 mg/L, at least 1325 mg/L, at least 1350 mg/L, at least 1375 mg/L, at least 1400 mg/L, at least 1425 mg/L, at least 1450 mg/L, at least 1475 mg/L, at least 1500 mg/L, at least 1525 mg/L, at least 1550 mg/L, at least 1575 mg/L, at least 1600 mg/L, at least 1625 mg/L, at least 1650 mg/L, at least 1675 mg/L, at least 1700 mg/L, at least 1725 mg/L, at least 1750 mg/L, at least 1775 mg/L, at least 1800 mg/L, at least 1825 mg/L, at least 1850 mg/L, at least 1875 mg/L, at least 1900 mg/L, at least 1925 mg/L, at least 1950 mg/L, at least 1975 mg/L, at least 2000 mg/L, or a range bounded by any two of the foregoing values.

In various embodiments, the fatty acid derivative enzyme activity comprises a thioesterase activity, an ester synthase activity, a fatty aldehyde biosynthesis activity, a fatty alcohol biosynthesis activity, or a hydrocarbon biosynthesis activity. In some embodiments, the recombinant microbial cell comprises polynucleotides encoding two or more polypeptides, each polypeptide having a fatty acid derivative enzyme activity.

In more particular embodiments, the recombinant microbial cell expresses or overexpresses one or more polypeptides having fatty acid derivative enzyme activity, as described hereinabove, wherein the recombinant microbial cell produces a composition comprising anteiso-branched fatty acids, anteiso-branched fatty esters, anteiso-branched wax esters, anteiso-branched fatty aldehydes, anteiso-branched fatty alcohols, anteiso-branched alkanes, anteiso-branched alkenes, anteiso-branched internal olefins, anteiso-branched terminal olefins, or anteiso-branched ketones.

The branched fatty acid derivatives (including iso-branched fatty acid derivatives and anteiso-branched fatty acid derivatives) produced by the methods of invention may be recovered or isolated from the recombinant microbial cell culture. The term "isolated" as used herein with respect to products, such as fatty acids and derivatives thereof, refers to products that are separated from cellular components, cell culture media, or chemical or synthetic precursors. The branched fatty acids and derivatives thereof produced by the methods described herein can be relatively immiscible in the fermentation broth, as well as in the cytoplasm. Therefore, the branched fatty acids and derivatives thereof can collect in an organic phase either intracellularly or extracellularly. The collection of the products in the organic phase can lessen the impact of the branched fatty acid derivative, e.g., branched fatty aldehyde or branched fatty alcohol on cellular function and can allow the recombinant microbial cell to produce more product.

In some embodiments, the branched fatty acid derivatives produced by the methods of invention are purified. As used herein, the term "purify," "purified," or "purification" means the removal or isolation of a molecule from its environment by, for example, isolation or separation. "Substantially purified" molecules are at least about 60% free (e.g., at least about 70% free, at least about 75% free, at least about 85% free, at least about 90% free, at least about 95% free, at least about 97% free, at least about 99% free) from other components with which they are associated. As used herein, these terms also refer to the removal of contaminants from a sample. For example, the removal of contaminants can result in an increase in the percentage of a branched fatty acid derivative (such as, a branched fatty acid or a branched fatty aldehyde or a branched fatty alcohol or a branched fatty ester or a branched hydrocarbon) relative to other components in a sample. For example, when a branched fatty aldehyde or a branched fatty alcohol is produced in a recombinant microbial cell, the branched fatty aldehyde or branched fatty alcohol can be purified by the removal of recombinant microbial cell proteins. After purification, the percentage of the branched fatty aldehyde or branched fatty alcohol in the sample relative to other components is increased.

As used herein, the terms "purify," "purified," and "purification" are relative terms which do not require absolute purity. Thus, for example, when a branched fatty acid or branched fatty acid derivative (e.g., a branched fatty aldehyde, a branched fatty alcohol, and so forth) is produced in recombinant microbial cells, a purified branched fatty acid or derivative is a branched fatty acid or derivative that is substantially separated from other cellular components (e.g., nucleic acids, polypeptides, lipids, carbohydrates, or other hydrocarbons).

The branched fatty acid derivative may be present in the extracellular environment, or it may be isolated from the extracellular environment of the recombinant microbial cell. In certain embodiments, a branched fatty derivative thereof is secreted from the recombinant microbial cell. In other embodiments, a branched fatty acid derivative is transported into the extracellular environment. In yet other embodiments, the branched fatty acid derivative is passively transported into the extracellular environment. A branched fatty acid derivative can be isolated from a recombinant microbial cell using methods known in the art.

Fatty acid derivatives (including branched fatty acid derivatives produced according to the methods of the present invention) can be distinguished from organic compounds derived from petrochemical carbon on the basis of dual carbon-isotopic fingerprinting or $^{14}C$ dating. Additionally, the specific source of biosourced carbon (e.g., glucose vs. glycerol) can be determined by dual carbon-isotopic fingerprinting (see, e.g., U.S. Pat. No. 7,169,588).

The ability to distinguish fatty acid derivatives produced by recombinant microbial cells from petroleum-based organic compounds is beneficial in tracking these materials in commerce. For example, organic compounds or chemicals comprising both biologically-based and petroleum-based carbon isotope profiles may be distinguished from organic compounds and chemicals made only of petroleum-based materials. Hence, the materials prepared in accordance with the inventive methods may be followed in commerce on the basis of their unique carbon isotope profile.

Fatty acid derivatives produced by recombinant microbial cells can be distinguished from petroleum-based organic compounds by comparing the stable carbon isotope ratio ($^{13}C/^{12}C$) in each fuel. The $^{13}C/^{12}C$ ratio in a given fatty acid derivative thereof produced according to the methods of the invention is a consequence of the $^{13}C/^{12}C$ ratio in atmospheric carbon dioxide at the time the carbon dioxide is fixed. It also reflects the precise metabolic pathway. Regional variations also occur. Petroleum, $C_3$ plants (the broadleaf), $C_4$ plants (the grasses), and marine carbonates all show significant differences in $^{13}C/^{12}C$ and the corresponding $\delta^{13}C$ values. Furthermore, lipid matter of $C_3$ and $C_4$ plants analyze differently than materials derived from the carbohydrate components of the same plants as a consequence of the metabolic pathway.

The $^{13}C$ measurement scale was originally defined by a zero set by Pee Dee Belemnite (PDB) limestone, where values are given in parts per thousand deviations from this material. The "$\delta^{13}C$" values are expressed in parts per thousand (per mil), abbreviated, % o, and are calculated as follows:

$$\delta^{13}C(\% o) = [(^{13}C/^{12}C)_{sample} - (^{13}C/^{12}C)_{standard}]/(^{13}C/^{12}C)_{standard} \times 1000$$

In some embodiments, a fatty acids or derivative thereof produced according to the methods of the invention has a $\delta^{13}C$ of about −30 or greater, about −28 or greater, about −27 or greater, about −20 or greater, about −18 or greater, about −15 or greater, about −13 or greater, or about −10 or greater. Alternatively, or in addition, a fatty acids or derivative thereof has a $\delta^{13}C$ of about −4 or less, about −5 or less, about −8 or less, about −10 or less, about −13 or less, about −15 or less, about −18 or less, or about −20 or less. Thus, the fatty acids or derivative thereof can have a $\delta^{13}C$ bounded by any two of the above endpoints. For example, a fatty acids or derivative thereof can have a $\delta^{13}C$ of about −30 to about −15, about −27 to about −19, about −25 to about −21, about −15 to about −5, about −13 to about −7, or about −13 to about −10. In some embodiments, a fatty acids or derivative thereof can have a $\delta^{13}C$ of about −10, −11, −12, or −12.3. In other embodiments, a fatty acids or derivative thereof has a $\delta^{13}C$ of about −15.4 or greater. In yet other embodiments, a fatty acids or derivative thereof has a $\delta^{13}C$ of about −15.4 to about −10.9, or a $\delta^{13}C$ of about −13.92 to about −13.84.

A fatty acid derivative produced by a recombinant microbial cell can also be distinguished from petroleum-based organic compounds by comparing the amount of $^{14}C$ in each compound. Because $^{14}C$ has a nuclear half life of 5730 years, petroleum based fuels containing "older" carbon can be distinguished from fatty acids or derivatives thereof which contain "newer" carbon (see, e.g., Currie, "Source Apportionment of Atmospheric Particles", *Characterization of Environmental Particles*, J. Buffle and H. P. van Leeuwen, Eds., Vol. I of the IUPAC Environmental Analytical Chemistry Series, Lewis Publishers, Inc., pp. 3-74 (1992)).

As used herein, "fraction of modern carbon" or $f_M$ has the same meaning as defined by National Institute of Standards and Technology (NIST) Standard Reference Materials (SRMs) 4990B and 4990C, known as oxalic acids standards HOxI and HOxII, respectively. The fundamental definition relates to 0.95 times the $^{14}C/^{12}C$ isotope ratio HOxI (referenced to AD 1950). This is roughly equivalent to decay-corrected pre-Industrial Revolution wood. For the current living biosphere (plant material), $f_M$ is approximately 1.1.

In some embodiments, a fatty acid derivative produced according to the methods of the invention has a $f_M{}^{14}C$ of at least about 1, e.g., at least about 1.003, at least about 1.01, at least about 1.04, at least about 1.111, at least about 1.18, or at least about 1.124. Alternatively, or in addition, the fatty acid or derivative has an $f_M{}^{14}C$ of about 1.130 or less, e.g., about 1.124 or less, about 1.18 or less, about 1.111 or less, or about 1.04 or less. Thus, the fatty acid or derivative can have a $f_M{}^{14}C$ bounded by any two of the above endpoints. For example, the fatty acid or derivative can have a $f_M{}^{14}C$ of about 1.003 to about 1.124, a $f_M{}^{14}C$ of about 1.04 to about 1.18, or a $f_M{}^{14}C$ of about 1.111 to about 1.124.

All references, including publications, patent applications, and patents, cited herein are hereby incorporated by reference to the same extent as if each reference were individually and specifically indicated to be incorporated by reference and were set forth in its entirety herein.

The use of the terms "a" and "an" and "the" and similar referents in the context of describing the invention (especially in the context of the following claims) are to be construed to cover both the singular and the plural, unless otherwise indicated herein or clearly contradicted by context. The terms "comprising," "having," "including," and "containing" are to be construed as open-ended terms (i.e., meaning "including, but not limited to,") unless otherwise noted. Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language ("e.g.", "such as", "for example") provided herein, is intended merely to better illuminate the invention and does not pose a limitation on the scope of the invention unless otherwise claimed. No language in the specification should be construed as indicating any non-claimed element as essential to the practice of the invention.

Preferred embodiments of this invention are described herein, including the best mode known to the inventors for carrying out the invention. Variations of those preferred embodiments may become apparent to those of ordinary skill in the art upon reading the foregoing description. The inventors expect skilled artisans to employ such variations as appropriate, and the inventors intend for the invention to be practiced otherwise than as specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context.

EXAMPLES

Media Compositions

M9 minimal media: 6 g/L $Na_2HPO_4$, 3 g/L $KH_2PO_4$, 0.5 g/L NaCl, 1 g/L $NH_4Cl$, 1 mg/L thiamine, 1 mM $MgSO_4$, 0.1 mM $CaCl_2$.

FA-2 media: M9 supplemented with Bis-Tris buffer (0.2 M), Triton X-100 (0.1% v/v), and trace minerals containing no iron (2 mg/L $ZnCl.4H_2O$, 2 mg/L $CaCl_2.6H_2O$, 2 mg/L $Na_2MoO_4.2H_2O$, 1.9 mg/L $CuSO_4.5H_2O$, 0.5 mg/L $H_3BO_3$, 100 mL/L concentrated HCl), ferric citrate (10 mg/L), and 30 g/L glucose.

Che-9 media: M9 supplemented with extra $NH_4Cl$ (an additional 1 g/L), Bis-Tris buffer (0.2 M), Triton X-100 (0.1% v/v), and trace minerals (27 mg/L $FeCl_3.6H_2O$, 2 mg/L $ZnCl.4H_2O$, 2 mg/L $CaCl_2.6H_2O$, 2 mg/L $Na_2MoO_4.2H_2O$, 1.9 mg/L $CuSO_4.5H_2O$, 0.5 mg/L $H_3BO_3$, 100 mL/L concentrated HCl).

V9-C media: Che-9 without $FeCl_3.6H_2O$

Che-92N-BT media: Che-9 supplemented with 20 g/L (2% w/v) glucose.

4NBT: Che-9 supplemented with 40 g/L (4% w/v) glucose.

Example 1

Engineering Production Strains

*E. coli* MG1655 ΔfadE (Strain "D1")

This example describes the construction of a recombinant microbial cell in which the expression of a fatty acid degradation enzyme is attenuated. The fadE gene of *E. coli* (also known as yafH), which encodes an acyl coenzyme A dehydrogenase (GenBank Accession No. AAC73325) involved in fatty acid degradation, was deleted from *E. coli* strain MG1655 using the Red system described by Datsenko, K. A. et al. (*Proc. Natl. Acad. Sci. USA* 97: 6640-6645 (2000)), with the following modifications.

The following two primers were used to create the deletion of fadE:

```
Del-fadE-F
                                    (SEQ ID NO: 238)
5' AAAAACAGCA ACAATGTGAG CTTTGTTGTAATTAT ATTGTAA ACATATT GATTCCGGGGATCCGTCGACC;
and Del-fadE-R
                                    (SEQ ID NO: 239)
5' AAACGGAGCCT TTCGGCTCCGTTATT CATTTACGCGGCTTCAAC

TTTCCTG TAGGCTGGAGCTGCTTC
```

The Del-fadE-F and Del-fadE-R primers were used to amplify the kanamycin resistance ($Km^R$) cassette from plasmid pKD13 (Datsenko et al., supra) by PCR. The PCR product was then used to transform electrocompetent *E. coli* MG1655 cells containing plasmid pKD46, which expresses Red recombinase (Datsenko et al., supra), which had been previously induced with arabinose for 3-4 hours. Following a 3-hour outgrowth in SOC medium at 37° C., the cells were plated on Luria agar plates containing 50 µg/mL of kanamycin. Resistant colonies were identified and isolated after an overnight incubation at 37° C. Disruption of the fadE gene was confirmed in some of the colonies by PCR amplification using primers fadE-L2 and fadE-R1, which were designed to flank the *E. coli* fadE gene.

```
                                    (SEQ ID NO: 240)
    fadE-L2 5'-CGGGCAGGTGCTATGACCAGGAC;
and (SEQ ID NO: 241)
    fadE-R1 5'-CGCGGCGTTGACCGGCAGCCTGG
```

After the fadE deletion was confirmed, a single colony was used to remove the $Km^R$ marker using the pCP20 plasmid (Datsenko et al., supra). The resulting MG1655 *E. coli* strain with the fadE gene deleted and the $Km^R$ marker removed was designated *E. coli* MG1655 ΔfadE, or strain "D1".

*E. coli* MG1655 ΔfadE ΔtonA (Strain "DV2")

This example describes the construction of a recombinant microbial cell in which the expression of a fatty acid degradation enzyme and the expression of an outer membrane protein receptor are attenuated. The tonA (also known as fhuA) gene of *E. coli* MG1655, which encodes a ferrichrome outer membrane transporter which also acts as a bacteriophage receptor (GenBank Accession No. NP_414692) was deleted from strain D1 (described above) using the Red system according to Datsenko et al., supra, with the following modifications:

The primers used to create the tonA deletion were:

```
Del-tonA-F
                                    (SEQ ID NO: 242)
5'-ATCATTCTCGTTTACGTTATCATTCACTTTACATCAGAGATATAC
CAATGATTCCGGGGATCCGTCGACC;
and Del-tonA-R
                                    (SEQ ID NO: 243)
5'-GCACGGAAATCCGTGCCCCAAAAGAGAAATTAGAAACGGAAGGTT
GCGG TTGTAGGCTGGAGCTGCTTC
```

The Del-tonA-F and Del-tonA-R primers were used to amplify the kanamycin resistance ($Km^R$) cassette from plasmid pKD13 by PCR. The PCR product obtained in this way was used to transform electrocompetent *E. coli* MG1655 D1 cells containing pKD46 (Datsenko et al., supra), which cells had been previously induced with arabinose for 3-4 hours. Following a 3-hour outgrowth in SOC medium at 37° C., cells were plated on Luria agar plates containing 50 µg/mL of kanamycin. Resistant colonies were identified and isolated after an overnight incubation at 37° C. Disruption of the tonA gene was confirmed in some of the colonies by PCR amplification using primers flanking the *E. coli* tonA gene: tonA-verF and tonA-verR:

```
                                    (SEQ ID NO: 244)
    tonA-verF 5'-CAACAGCAACCTGCTCAGCAA;
and (SEQ ID NO: 245)
    tonA-verR 5'-AAGCTGGAGCAGCAAAGCGTT
```

After the tonA deletion was confirmed, a single colony was used to remove the $Km^R$ marker using the pCP20 plasmid (Datsenko et al., supra). The resulting MG1655 *E. coli* strain having fadE and tonA gene deletions was designated *E. coli* MG1655 ΔfadE ΔtonA, or strain "DV2".

*E. coli* MG1655 ΔfadE ΔtonA lacI:tesA (Strain "DV2 'tesA")

This example describes the construction of a recombinant microbial cell comprising a polynucleotide encoding a polypeptide having a fatty acid derivative enzyme activity. The tesA polynucleotide sequence encoding *E. coli* acyl-CoA thioesterase I (EC 3.1.1.5, 3.1.2.-; e.g., GenBank Accession AAC73596; SEQ ID NO:202) was modified to remove the leader sequence, such that the resulting 'tesA gene product was truncated by 25 amino acids and the amino acid at the original position 26, alanine, was replaced with methionine, which then became the first amino acid of the 'TesA polypeptide sequence (SEQ ID NO:204; Cho et al., *J. Biol. Chem.*, 270:4216-4219 (1995)).

An integration cassette containing the 'tesA coding sequence operatively linked to the $P_{Trc}$ promoter plus a kanamycin resistance gene was PCR-amplified from plasmid pACYC-$P_{Trc}$-tesA (Example 2) using the primers lacI-forward: GGCTGGCTGGCATAAATATCTC (SEQ ID NO:313) and lacZ-reverse: GCGTTAAAGTTGTTCTGCT-TCATCAGCAGGATATCCTGCACCATCGTCTGGATTT-TGAACTTTTGCTTTGCCACGGAAC (SEQ ID NO:314), electroporated into strain DV2 and integrated into the chromosome using Red recombinase expressed from the pKD46 plasmid (Datsenko et al., supra). The transformants were selected on LB plates supplemented with kanamycin. Correct integration was assessed using diagnostic PCR.

Example 2

Engineering Cells for Production of Branched Chain Fatty Acids

The following examples describe the construction of recombinant microbial cells comprising polynucleotide sequences encoding branched chain alpha-ketoacid dehydrogenase (BKD) complexes according to part (C) of the BCFA pathway shown in FIG. 1, and polynucleotide sequences encoding branched chain-specific β-ketoacyl-ACP synthases (i.e., FabH polypeptides) according to part (D) of the BCFA pathway of FIG. 1. The strains exemplified herein also comprise polynucleotide sequences encoding fatty acid derivative enzymes, such as the modified *E. coli* 'tesA gene which expresses a thioesterase and generates fatty acids. This example demonstrates that recombinant *E. coli* strains engineered to express a BKD complex and a branched chain β-ketoacyl-ACP synthase produce branched chain fatty acids.

I. BDK Plasmids

*Bacillus subtilis* bkd (pKZ2 Plasmid)

*B. subtilis* bkd genes were amplified from *B. subtilis* 168 genomic DNA using the following primers:

```
                                         (SEQ ID NO: 246)
B.s.BKD_R: 5'-GCTCTCGAGTTAGTAACAGATGTCTTC-3';
and
                                         (SEQ ID NO: 247)
B.s.BKD_F(4g): 5'-GCGGATCCATGGCAACTGAGTATGACG-3'
```

Primers B.s.BKD_F(4g) and B.s.BKD_R amplified genes bkdAA (encoding the alpha subunit of the E1 component, UniProtKB P37940, GenBank NP_390285; SEQ ID NO:1), bkdAB (encoding the beta subunit subunit of the E1 component, UniProtKB P37941, GenBank NP_390284; SEQ ID NO:22), bkdB (encoding the E2 component, UniProtKB P37942, GenBank NP_390283; SEQ ID NO:43), and lpdV (encoding the E3 component, UniProtKB P54533, GenBank NP_390286.2; SEQ ID NO:63). The PCR products were cloned into vector pGL10.173B (SEQ ID NO:228), a pBR322 based plasmid with a $P_{trc}$ promoter, to produce the pKZ2 plasmid. Correct insertion of the PCR products was verified using diagnostic restriction enzyme digests.

*Pseudomonas putida* bkd (pKZ4 Plasmid)

*P. putida* bkd genes were amplified from *P. putida* F1 genomic DNA using the following primers:

```
P.p.BKDFusion_F:
                                         (SEQ ID NO: 248)
5'-ATAAACCATGGATCCATGAACGAGTACGCCCC-3'

P.pBKDFusion_R:
                                         (SEQ ID NO: 249)
5'-CCAAGCTTCGAATTCTCAGATATGCAAGGCGTG-3'
```

Primers P.p.BKDFusion_F and P.p.BKDFusion_R amplified *P. putida* genes Pput_1450 (encoding the E3 component, UniProtKB Accession No. A5W0E08; SEQ ID NO:67), Pput_1451 (encoding the E2 component, UniProtKB Accession No. A5W0E9; SEQ ID NO:47), Pput_1452 and Pput_1453 (encoding the E1 alpha and E1 beta subunits, UniProtKB A5W0F1 and A5W0F0, SEQ ID NOs:5 and 26, respectively). The PCR products were cloned into vector pGL10.173B (a pBR322 based plasmid with a Ptrc promoter; SEQ ID NO:228) to produce the pKZ4 plasmid (SEQ ID NO:231). Correct insertion of the PCR products was verified using diagnostic restriction enzyme digests.

*Listeria monocytogenes* bkd (pTB85 Plasmid)

*L. monocytogenes* bkd genes were amplified from *L. monocytogenes* L123 (ATCC 19114D-5) genomic DNA using the following primers:

```
primer 81 (BKD_forward)
                                         (SEQ ID NO: 250)
GAGGAATAAACCGTGGCAACAGAATATGATGTCGTTATTCT primer 82 (BKD_reverse)
                                         (SEQ ID NO: 251)
CCCAAGCTTCGAATTTTAATACAATGCTGTATTTTCTTTGGAAAT
```

The *L. monocytogenes* bkd operon (SEQ ID NO:232) generated by PCR was cloned into the NcoI and EcoRI sites of pGL10.173B (a pBR322 based plasmid with a Ptrc promoter; SEQ ID NO:228) to generate the plasmid pTB85.

II. FabH Plasmids pDG2 Expression Vector

The pDG2 expression vector was the base plasmid for may of the constructs described below. The pCDFDuet-1 vector (Novagen/EMD Biosciences) carries the CloDF13 replicon, lacI gene and streptomycin/spectinomycin resistance gene (aadA). To construct the pDG2 plasmid, the C-terminal portion of the plsX gene, which contains an internal promoter for the downstream fabH gene (Podkovyrov and Larson, *Nucl. Acids Res.* (1996) 24 (9): 1747-1752 (1996)) was amplified from *E. coli* MG1655 genomic DNA using primers

```
                                         (SEQ ID NO: 252)
5'-TGAATTCCATGGCGCAACTCACTCTTCTTTTAGTCG-3'
and
                                         (SEQ ID NO: 253)
5'-CAGTACCTCGAGTCTTCGTATACATATGCGCT CAGTCAC-3'
```

These primers introduced NcoI and XhoI restriction sites near the ends, as well as an internal NdeI site.

Both the plsX insert (containing the EcfabH promoter), and the pCDFDuet-1 vector, were digested with restriction enzymes NcoI and XhoI. The cut vector was treated with Antarctic phosphatase. The insert was ligated into the vector and transformed into transformation-competent *E. coli* cells. Clones were screened by DNA sequencing. The pDG2 plasmid sequence is provided herein as SEQ ID NO: 229.

*B. subtilis* fabH1 (pDG6), *B. subtilis* fabH2 (pDG7) and *Streptomyces coelicolor* fabH (pDG8)

The pDG6 plasmid was constructed using the pDG2 plasmid. The fabH1 coding sequence was amplified from *Bacillus subtilis* strain 168 using primers

```
                                         (SEQ ID NO: 254)
5-CCTTGGGGCATATGAAAGCTG-3'
and
                                         (SEQ ID NO: 255)
5'-TTTAGTCATCTCGAGTGCACCTCACCTTT-3'.
```

These primers introduced NdeI and XhoI restriction sites at the ends of the amplification product.

Both the fabH1 insert and the pDG2 vector were digested with restriction enzymes NdeI and XhoI. The cut vector was treated with Antarctic phosphatase. The insert was ligated into the vector and transformed into transformation-competent *E. coli* cells. Clones were screened by DNA sequencing. The pDG6 plasmid sequence is provided herein as SEQ ID NO: 230, and expresses the *B. subtilis* FabH1 polypeptide (SEQ ID NO:84) under the control of the EcfabH promoter.

Other plasmids based on pDG2 were prepared using a similar strategy as for the pDG6 plasmid. Plasmid pDG7 comprises a *Bacillus subtilis* fabH2 insert which expresses the *B. subtilis* FabH2 polypeptide (SEQ ID NO:86). Plasmid pDG8 comprises a *Streptomyces coelicolor* fabH insert which expresses the *S. coelicolor* FabH polypeptide (SEQ ID NO:96).

*B. subtilis* fabH1 (pKZ5 Plasmid)

Plasmid pKZ5 was constructed by cloning the NcoI-AvrII fragment of pDG6, containing BsFabH1 under control of the EcfabH promoter, into the NcoI-AvrII cut vector pACYC-Duet-1 (Novagen). Plasmid pKZ5 carries a chloramophenicaol resistance gene and a streptomycin/spectinomycin resistance gene.

III. Other Plasmids pACYC-P$_{Trc}$-tesA and pACYC-P$_{Trc2}$-tesA Plasmids

Plasmid pACYC-P$_{Trc}$ was constructed by PCR-amplifying the lacI$^q$, P$_{Trc}$ promoter and terminator region from pTrcHis2A (Invitrogen, Carlsbad, Calif.) using primers

```
                                          (SEQ ID NO: 258)
pTrc_F  TTTCGCGAGGCCGGCCCCGCCAACACCCGCTGACG
and
                                          (SEQ ID NO: 259)
pTrc_R  AAGGACGTCTTAATTAATCAGGAGAGCGTTCACCGACAA
```

The PCR product was then digested with AatII and NruI and inserted into plasmid pACYC177 (Rose, R. E., *Nucleic Acids Res.*, 16:356 (1988)) digested with AatII and ScaI. The nucleotide sequence of the pACYC-P$_{Trc}$ vector is provided herein as SEQ ID NO: 233.

To generate the pACYC-P$_{Trc2}$ vector, a single point mutation was introduced in the P$_{Trc}$ promoter of the pACYC-P$_{Trc}$ vector to generate the variant promoter P$_{Trc2}$ and the pACYC-P$_{Trc2}$ vector. The wild-type P$_{Trc}$ promoter sequence is provided herein as SEQ ID NO:234, and the P$_{Trc2}$ variant promoter is provided herein as SEQ ID NO:235.

The nucleotide sequence encoding *E. coli* acyl-CoA thioesterase I (TesA, EC 3.1.1.5, 3.1.2.-; e.g., GenBank Accession AAC73596; SEQ ID NO:202) was modified to remove the leader sequence, such that the resulting 'tesA gene product was truncated by 25 amino acids and the amino acid at the original position 26, alanine, was replaced with methionine, which then became the first amino acid of the 'TesA polypeptide (SEQ ID NO:204; Cho et al., *J. Biol. Chem.*, 270:4216-4219 (1995)). DNA encoding the 'TesA polypeptide was inserted into the NcoI and EcoRI sites of the pACYC-P$_{Trc}$ vector and the pACYC-P$_{Trc2}$ vector, producing the pACYC-P$_{Trc}$-tesA and pACYC-P$_{Trc2}$-tesA plasmids, respectively. Correct insertion of 'tesA sequence into the plasmids was confirmed by restriction digestion.

*C. acetobutylicum* phosphotransbutyrylase-butyrate Kinase (pDG10 Plasmid)

The plasmid pDG10 was prepared using the PCR-Blunt vector (Invitrogen, Carlsbad, Calif.) and a *C. acetobutylicum* ptb_buk operon insert, wherein the ptb part represents the gene encoding *C. acetobutylicum* phosphotransbutyrylase (GenBank Accession AAA75486.1, SEQ ID NO:227), and the buk part represents the gene encoding *C. acetobutylicum* butyrate kinase (GenBank Accession JN0795, SEQ ID NO:226). The buk ptb operon was amplified from *C. acetobutylicum* (ATCC 824) genomic DNA using primers 5'-CTTAACTTCATGTGAAAAGTTTGT-3' (SEQ ID NO:260) and 5'-ACAATACCCATGTTTATAGGGCAA-3' (SEQ ID NO:261). The PCR product was ligated into the PCR-Blunt vector following the manufacturer's instructions.

Example 3

Production of Branched Fatty Acids in *E. coli* Engineered to Express Exogenous bkd and fabH Genes The following *E. coli* strains were prepared as described above:

DV2'tesA (MG1655 ΔfadE ΔtonA lacI:tesA) is *E. coli* strain DV2 which in addition expresses a leaderless 'tesA gene for production of fatty acids.

DV2'tesA+BsfabH1 is the DV2'tesA strain transformed with the pDG6 plasmid expressing the *B. subtilis* fabH1 gene.

DV2'tesA+BsfabH1+Bsbkd is the DV2'tesA strain transformed with the pDG6 plasmid expressing the *B. subtilis* fabH1 gene, and the pKZ2 plasmid expressing the *B. subtilis* bkd operon.

DV2'tesA+BsfabH1+Ppbkd is the DV2'tesA strain transformed with the pDG6 plasmid expressing the *B. subtilis* fabH1 gene, and the pKZ4 plasmid expressing the *P. putida* bkd operon.

Seed cultures were grown in LB supplemented with the appropriate antibiotics. After 4 hours of growth, the cultures were diluted 1:25 in Che-92NBT medium (2% glucose, nitrogen limited medium, 0.2 M Bis-Tris, pH 7.0, 0.1% Triton)+ appropriate antibiotics and grown overnight. The cultures were then diluted in 4NBT (4% glucose, nitrogen limited medium, 0.2M Bis-Tris, pH 7.0, 0.1% Triton) to a final OD$_{600}$ ~0.2. After 6 hours of growth, IPTG was added to a final concentration of 1 mM. At 24 hours post-induction, 1 ml of culture was extracted with 500 µl ethyl acetate (containing 1% HCl), derivatized with freshly prepared TMAH and subjected to GC/MS analysis.

TABLE 7

Production of Branched Fatty Acids

Figure 4:
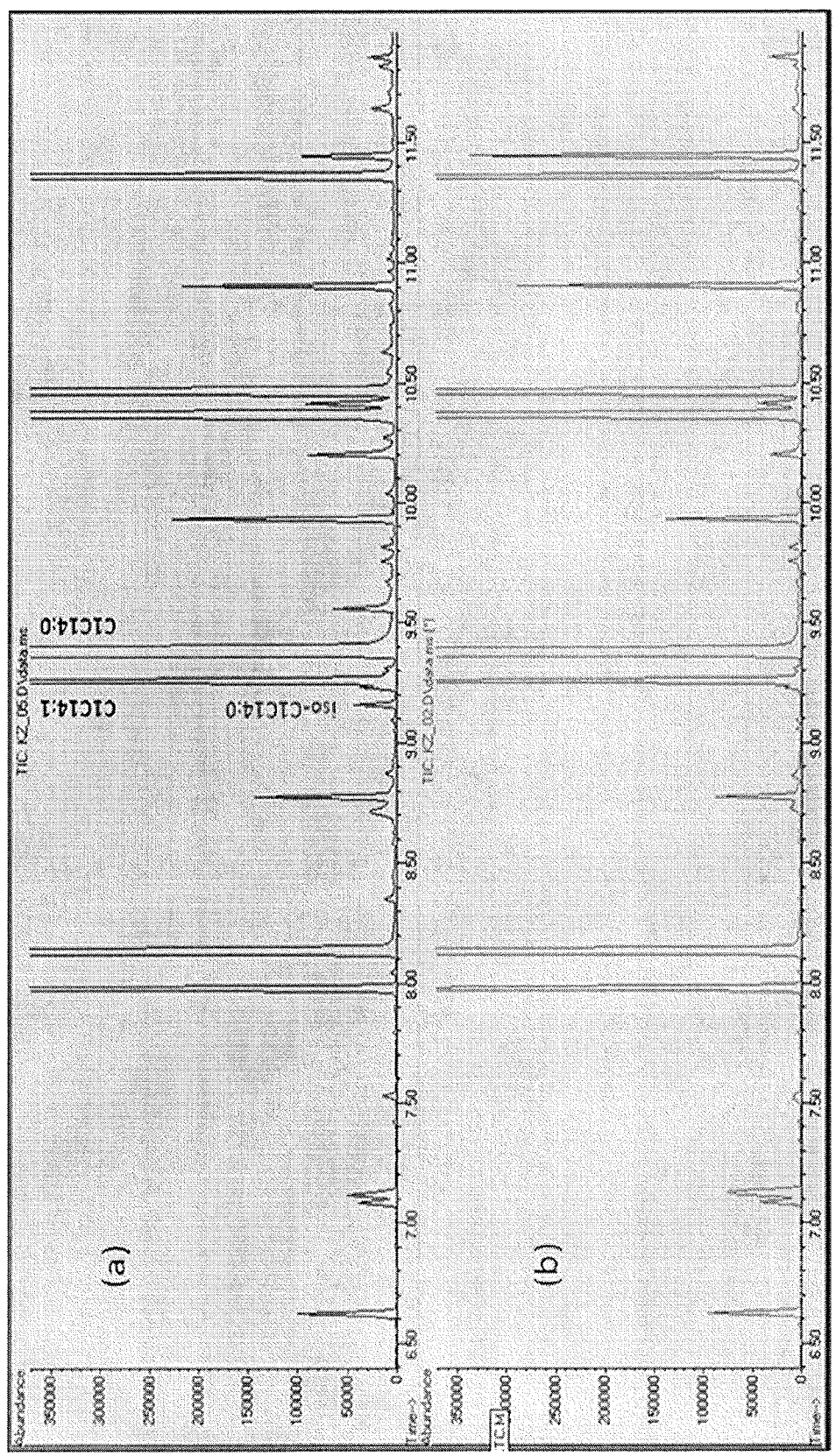
FIG. 4 shows representative GC-MS traces of (a) fatty acids produced by an E. coli strain expressing a leaderless TesA polypeptide and B. subtilis FabH1 protein, compared to (b) fatty acids produced by the same E. coli strain which does not express the B. subtilis FabH1 protein. The peaks corresponding to iso-branched chain C14 fatty acids, straight-chain monounsaturated C14 fatty acids, and straight-chain saturated C14 fatty acids produced by these strains are labeled "iso-C1C14:0", "C1C14:1" and "C1C14:1", respectively, due to the TMAH derivitization procedure used, which converted the fatty acids to fatty acid methyl esters prior to the GC/MS analysis.

| Strain | Total FFA titer | Total BCFA titer | Total BCFA/ Total FFA | Total Anteiso- BCFA titer | Anteiso/ Total BCFA |
|---|---|---|---|---|---|
| DV2'tesA | ~2000 | 0 | 0 | 0 | 0 |
| DV2'tesA + BsfabH1 (pDG6) | ~2000 | 3 | .0015 | 0 | 0 |
| DV2'tesA + BsfabH1 (pDG6) + Ppbkd (pKZ4) | 2130 | 580 | .27 | 100 | 0.17 | all titers are in milligrams per liter
FFA = free fatty acid;
BCFA = branched chain fatty acid Results:

*E. coli* does not normally produce branched-chain fatty acids. FIG. 4(*b*) is a GC/MS analysis of free fatty acids (FFA) produced by the control *E. coli* strain (DV2'tesA) which expresses a thioesterase gene but lacks enzymes of parts (C) and (D) of the BCFA pathway, and which shows no detectable production of branched chain fatty acids. Engineering the *E. coli* strain to also express an exogenous fabH gene, encoding a polypeptide having beta-ketoacyl-ACP synthase III activity that utilizes a branched acyl-CoA molecule as a substrate corresponding to part (D) of the BCFA pathway, resulted in the production of a barely detectable amount of branched-chain fatty acids, corresponding to less than about 2% of the total FFA produced (FIG. 4(*a*)). The *E. coli* DV2'tesA strain produced about 2000 mg/L free fatty acids, with no detectable branched chain fatty acids, while the DV2'tesA+BsfabH1 strain expressing the BsfabH1 gene likewise produced about 2000 mg/L FFA, approximately 3 mg/L (<2%) of which was branched-chain fatty acids, essentially all of which were in the iso-branched configuration (Table 7).

Figure 5:
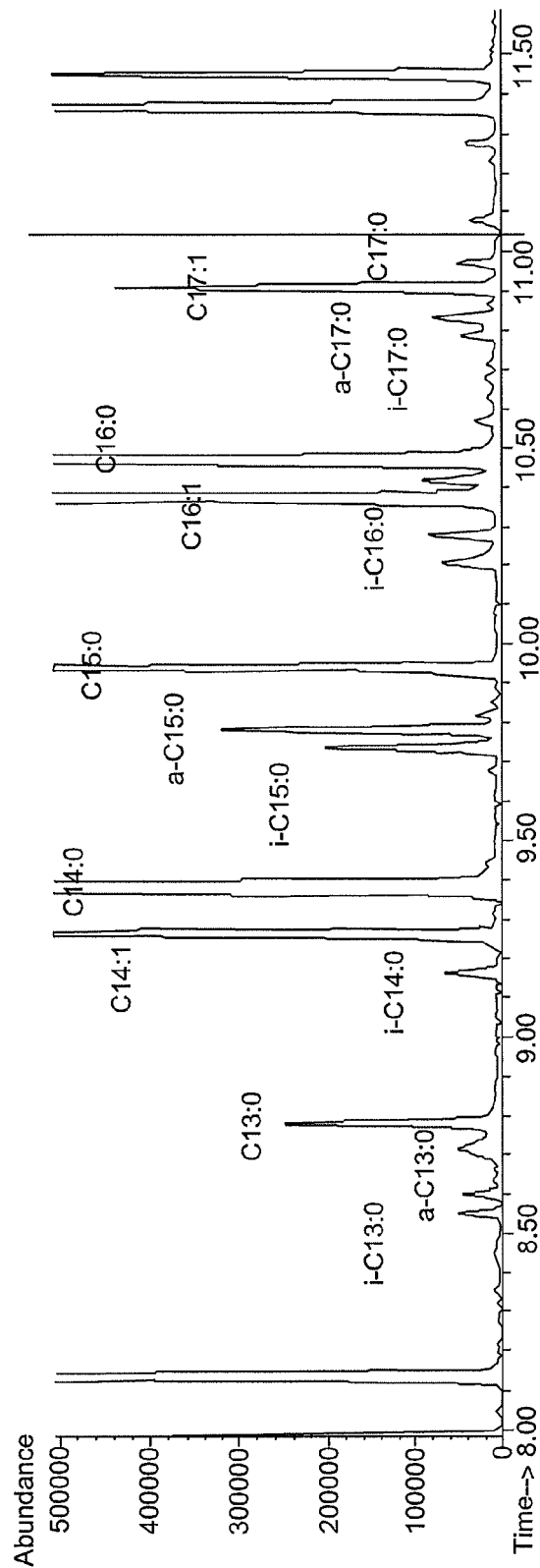
FIG. 5 shows a representative GC/MS trace of fatty acids produced by an E. coli strain expressing a leaderless TesA polypeptide, B. subtilis BKD complex and B. subtilis FabH1. The peaks corresponding to iso-branched ("i-"), anteiso-branched ("a-"), monounsaturated (Cn:1) and saturated (Cn:0) fatty acids of chain length (Cn) from C13 to C17 are labeled accordingly.

Branched fatty acid production increased dramatically when the *E. coli* strain was engineered to express bkd genes encoding polypeptides having branched-chain alpha-keto acid dehydrogenase activity, lipoamide acyltransferase activity, and dihydrolipoamide dehydrogenase activity (corresponding to part (C) of the BCFA pathway), along with the exogenous fabH gene. As can be seen in FIG. 5, expression of the *B. subtilis* bkd genes together with the *B. subtilis* fabH1 gene produced a variety of branched fatty acid structures, including branched fatty acids with chain lengths from C13 to C17 in iso-branched (denoted "i-") and anteiso-branched (denoted "a-") forms.

Figure 6:
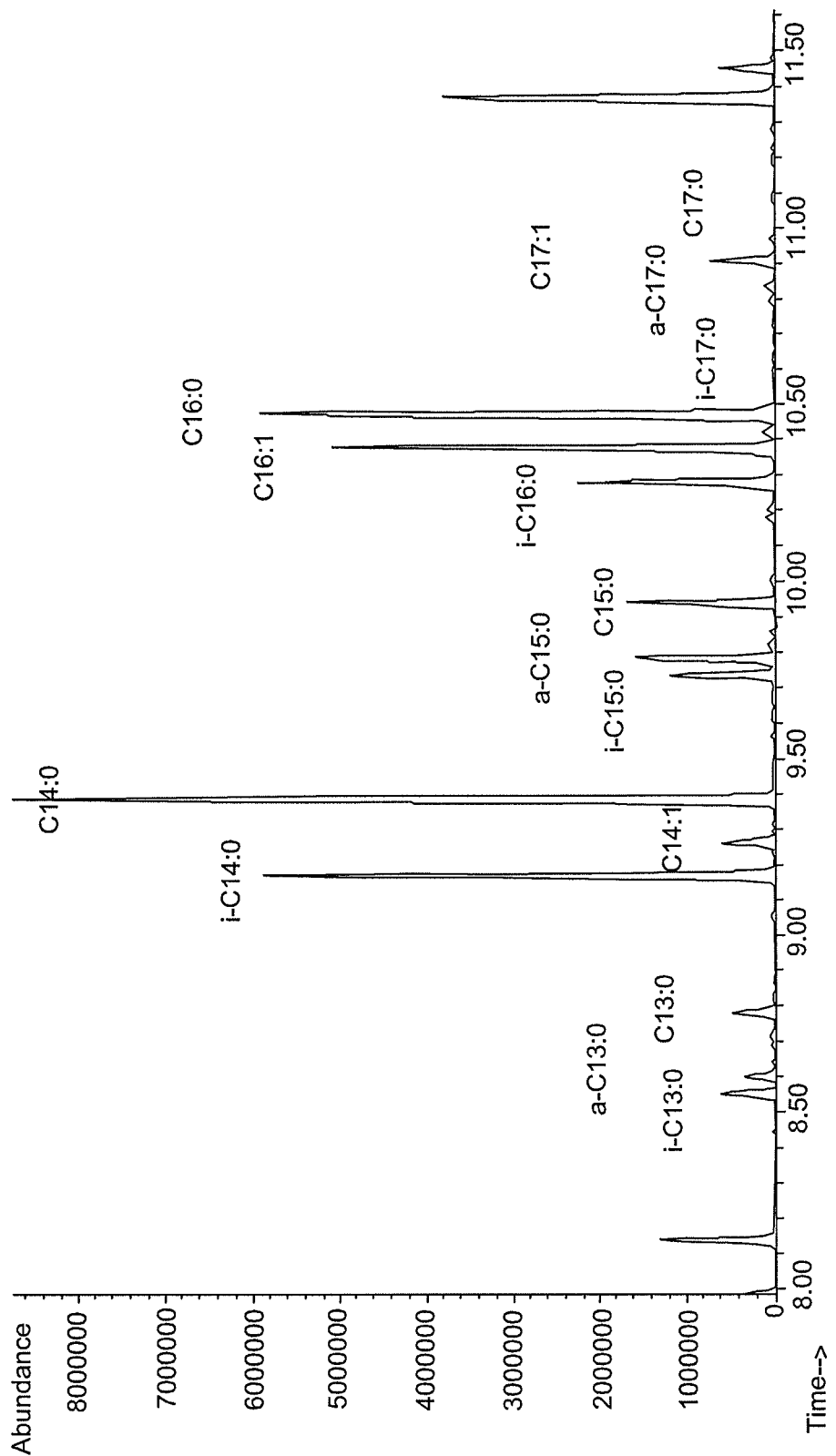
FIG. 6 shows a representative GC/MS trace of fatty acids produced by an E. coli strain expressing a leaderless TesA polypeptide, P. putida BKD complex and B. subtilis FabH1. The peaks corresponding to iso-branched ("i-"), anteiso-branched ("a-"), monounsaturated (Cn:1) and saturated (Cn:0) fatty acids of chain length (Cn) from C13 to C17 are labeled accordingly.

When *P. putida* bkd genes were expressed together with the *B. subtilis* fabH1 gene, the resulting DV2'tesA+BsfabH1+Ppbkd strain likewise produced branched fatty acids with chain lengths from C13 to C17 in iso-branched and anteiso-branched forms (FIG. 6). Approximately 27% (by weight) of the FFA produced by this strain were branched fatty acids; approximately 83% of those branched fatty acids were in the iso-form and approximately 17% of those branched fatty acids were in the anteiso-form (Table 7).

Example 4

Engineering *E. coli* for Production of
Anteiso-Branched Fatty Acids by Pathway (A.1)

The following example describes the construction of recombinant *E. coli* strains which express exogenous genes and/or overexpress endogenous genes encoding enzymes which serve to increase metabolic flux through the intermediates α-ketobutyrate, the anteiso-branched α-keto acid intermediate α-keto-β-methylvalerate, and the anteiso-branched chain primer 2-methylbutyryl-CoA by the (A.1) part of the pathway of FIG. 3A, leading to the increased production of anteiso-branched acyl-ACP, and ultimately anteiso-branched fatty acid derivatives, in these recombinant cells.

This example also describes the effect of attenuating expression of an undesired endogenous gene on BCFA production. In this example, the fabH gene of *E. coli* encoding a beta-ketoacyl-ACP synthase III, which utilizes straight-chain acyl-CoA molecules instead of branched-chain acyl-CoA molecules, was attenuated by deletion of that gene. This example also describes the effect on BCFA production of chromosomally integrating an exogenous BKD operon (corresponding to part (C) of the BCFA pathway of FIGS. 1 and 3B).

DV2 $P_L$ thrA*BC

This example describes the construction of a recombinant *E. coli* strain in which one of the chromosomal genes involved in threonine biosynthesis was mutated and was placed under control of a chromosomally-integrated lambda $P_L$ promoter.

To introduce a single mutation in the native aspartokinase I (thrA) gene, the gene was amplified from *E. coli* MG1655 DNA in two parts. The first part was amplified using primers TREE026 and TREE028 while the second part was amplified using TREE029 and TREE030 (Table 8). The primers used to amplify the two components contained overlapping sequences which were then used to "stitch" the individual pieces together. The two PCR products were combined in a single PCR reaction and primers TREE026 and TREE030 to amplify the entire thrA gene. Primers TREE028 and TREE029 were designed to create a mutation in the native thrA at codon 345, which resulted in an S345F variant of aspartokinase I (SEQ ID NO: 118). Previous work has shown that this mutation eliminates feedback inhibition by threonine in the host strain (Ogawa-Miyata, Y., et al., *Biosci. Biotechnol. Biochem.* 65:1149-1154 (2001); Lee J.-H., et al., *J. Bacteriol.* 185: 5442-5451 (2003)). The modified version of this gene was designated "thrA*".

The $P_L$ promoter was amplified using primers Km_trc_overF and TREE027 (Table 8) using plasmid pDS80 (Example 2) as a template. This fragment was then stitched to a kanamycin resistance cassette flanked by FRT sites, which was amplified from plasmid pKD13 using primers TREE025 and Km_trc_overR (Table 8). The resulting PCR product containing the KmFRT cassette and $P_L$ promoter was stitched to the thrA*PCR product. Primers TREE025 and TREE030 were used to amplify the entire KmFRT-$P_L$-thrA* mutagenic cassette. These primers also contain approximately 50 bp of homology to the integration site at the 5' end and the entire thrA gene as homology on the 3' end, targeting the cassette to the native thrA site in *E. coli*, which is part of an operon comprising the thrA, thrB and thrC genes. This mutagenic cassette was electroporated into the parental strain, *E. coli* DV2 (Example 1) containing the helper plasmid pKD46 expressing Red recombinase (Datsenko et al., supra). Clones containing the chromosomal integration were selected in the presence of kanamycin, and verified by diagnostic PCR. The kanamycin marker was then removed by expression of the pCP20 plasmid (Datsenko et al., supra). Proper integration and marker removal were verified by PCR and sequencing. The resulting strain, in which the mutant thrA* gene and the endogenous thrB and thrC genes were overexpressed by the chromosomally-integrated lambda $P_L$ promoter, was designated DV2 $P_L$ thrA*BC.

TABLE 8

Primers

| Primer | Sequence (5' → 3') | SEQ ID No: |
|---|---|---|
| TREE025 | CCTGACAGTGCGGGCTTTTTTTTCGACCAAAGGTAACGAGGTAACAACCGTGTAGGCTGGAGCTGCTTCG | 262 |
| TREE026 | GTATATATTAATGTATCGATTAAATAAGGAGGAATAAACCATGCGAGTGTTGAAGTTCGGCG | 263 |
| TREE027 | CTGATGTACCGCCGAACTTCAACACTCGCATGGTTTATTCCTCCTTATTTAATCGATAC | 264 |
| TREE028 | GCGCCCGTATTTTCGTGGTGCTGATTAC | 265 |
| TREE029 | GTAATCAGCACCACGTAAATACGGGCGC | 266 |
| TREE030 | TCAGACTCCTAACTTCCATGAGAGG | 267 |
| Km_trc_overR | AATATTTGCCAGAACCGTTATGATGTCGGCATTCCGGGGATCCGTCGACC | 268 |
| Km_trc_overF | CTTCGAACTGCAGGTCGACGGATCCCCGGAATGCCGACATCATAACGGTTCTGGC | 269 |
| EG238 | GCTGATCATTAACTATCCGCTGGATGACC | 270 |
| TREE017 | ACTGGAAAGCGGGCAGTGAGCGCAACGCAATTAATGTAAG | 271 |
| TREE018 | TCACTGCCCGCTTTCC | 272 |
| TREE019 | ACCGGCAGATCGTATGTAATATGCATGGTTTATTCCTCCTTATTTAATCGATACA | 273 |
| TREE020 | ATGCATATTACATACGATCTGCC | 274 |
| TREE021 | GGTCGACGGATCCCCGGAATTAAGCGTCAACGAAACCG | 275 |
| TREE022 | GAAGCAGCTCCAGCCTACACCAGACGATGGTGCAGGAT | 276 |
| TREE023 | GCAAAGACCAGACCGTTCATA | 277 |
| Kan/Chlor 1 | ATTCCGGGGATCCGTCGACC | 278 |
| Kan/Chlor 4 | TGTAGGCTGGAGCTGCTTCG | 279 |
| TREE025 | CCTGACAGTGCGGGCTTTTTTTTCGACCAAAGGTAACGAGGTAACAACCGTGTAGGCTGGAGCTGCTTCG | 280 |
| TREE026 | GTATATATTAATGTATCGATTAAATAAGGAGGAATAAACCATGCGAGTGTTGAAGTTCGGCG | 281 |

To evaluate the effect of $P_L$ thrA*BC overexpression in DV2, the following three plasmids (described in Example 2) were transformed into this strain: pKZ4, which expressed the P. putida BKD operon; pDG6, which expressed B. subtilis fabH1; and pACYC-p$_{trc2}$-tesA, which expressed a truncated form of E. coli tesA. Shake flask fermentation experiments were conducted, and the titers of free fatty acids (FFA), branched fatty acids (BCFA), and anteiso-branched fatty acids (anteiso-BCFA), along with the fraction of FFA produced as BCFA and the fraction of BCFA produced as anteiso-BCFA, is provided in Table 10.

DV2 P$_L$ thrA*BC P$_L$ tdcB

The native E. coli catabolic threonine deaminase (tdcB) gene (also known as threonine ammonia-lyase) was overexpressed by integrating an extra copy of the gene into the lacZ locus and placing it under the control of a strong non-inducible promoter.

Catabolic threonine deaminase catalyzes the degradation of threonine to α-keto-butyrate (2-oxobutanoate), the first reaction of the threonine degradation/isoleucine production pathway. The reaction catalyzed probably involves initial elimination of water (hence the enzyme's earlier identification as a threonine dehydratase), followed by isomerization and hydrolysis of the product with C—N bond breakage. Increased expression of this gene has been shown to dramatically increase levels of isoleucine in heterologous organisms (Guillouet S. et al., Appl. Environ. Microbiol. 65:3100-3107 (1999)). Furthermore, threonine deaminase is relatively resistant to isoleucine feedback mechanisms (Guillouet et al., supra).

E. coli MG1655 genomic DNA was amplified using primers TREE020 and TREE021 (Table 8) to obtain the native tdcB gene. At the same time, primers Chlor 1 and Chlor 4 (Table 8) were used to amplify an FRT-Kanamycin resistance cassette to be used for integration selection/screening as previously described. Using E. coli MG1655 genomic DNA as template, primers EG238 and TREE018 (Table 8) were used to amplify a region of homology 3' to the lacZ integration site, while primers TREE022 and TREE023 (Table 8) were used to amplify a region of homology 5' to the lacZ site. The plasmid pDS80 (Example 2) was used as a template to amplify a fragment containing the P$_L$ promoter by using primers TREE017 and TREE018 (Table 8). Each of these fragments were designed with overlaps for corresponding adjacent piece and were stitched together using SOEing PCR techniques. The resulting P$_L$ tdcB mutagenic cassette (approx. 4.3 kb) contained approximately 700 bp of homology to the integration site at the 5' end and 750 bp of homology to the integration site at the 3' end. The P$_L$ tdcB mutagenic cassette was electroporated into the host strain, E. coli DV2 P$_L$ thrA*BC containing the helper plasmid, pKD46 (Datsenko et al., supra). Clones containing the chromosomal integration were selected for in the presence of kanamycin, and verified by PCR and sequencing analysis. The kanamycin marker was then removed using the pCP22 plasmid (Datsenko et al., supra). The resulting strain was designated DV2 P$_L$ thrA*BC P$_L$ tdcB.

To evaluate the effect of P$_L$ tdcB integration into DV2 P$_1$ thrA*BC, the following three plasmids (described in Example 2) were transformed into this strain: pKZ4, which expressed the P. putida BKD operon; pDG6, which expressed B. subtilis fabH1; and pACYC-p$_{trc2}$-tesA, which expressed a truncated form of E. coli tesA. Shake flask fermentation experiments were conducted, and the titers of free fatty acids (FFA), branched fatty acids (BCFA), and anteiso-branched fatty acids (anteiso-BCFA), along with the fraction of FFA produced as BCFA and the fraction of BCFA produced as anteiso-BCFA, is provided in Table 10.

DV2 P$_L$-thrA*BC P$_{T5}$-BsfabH1

This example describes the construction of a recombinant microbial cell in which the B. subtilis fabH1 gene was integrated into the chromosome and placed under transcriptional control of the strong constitutive T5 promoter.

First, a PCR product was generated for the chromosomal integration of a loxPcat integration cassette comprising a chloramphenicol resistance gene, a T5 promoter (P$_{T5}$), and BsfabH1 coding sequence, at the site of the fadE deletion scar of DV2 P$_L$ thrA*BC. The individual components of the integration cassette were first PCR-amplified. The loxP-cat-loxP P$_{T5}$ component was amplified from plasmid p100.38 (SEQ ID NO:237) using primers TREE133 and TREE135 (Table 9). The BsfabH1 gene was amplified from a plasmid carrying the BsfabH1 gene using primers TREE134 and TREE136. Primers TREE133 and TREE136 contain the 5' and 3' 50 bp of homology sequence for integration. The primers used to amplify the components contain overlapping sequence which were then used to "stitch" the individual pieces together. The loxP-cat-P$_{T5}$ and BsfabH1 PCR products were stitched together by combining both pieces in a single PCR reaction and using primers TREE133 and TREE136 to amplify the final loxPcat-P$_{T5}$-BsfabH1 integration cassette.

TABLE 9

Primers

| Primer Name | Sequence | Purpose | SEQ ID NO: |
|---|---|---|---|
| TREE133 | AAAAACAGCAACAATGTGAGC TTTGTTGTAATTATATTGTAA ACATATTGTCCGCTGTTTCTG CATTCTTACgt | Amplify loxPcat-T5 cassette | 282 |
| TREE134 | GATGACGACGAACACGCATTa agGAGGTGAATAAGGAGGAAT AAcatATGAAAGCTGGCATTC TTGGTGTTG | Amplify BsfabH1 | 283 |
| TREE135 | GTAACGTCCAACACCAAGAAT GCCAGCTTTCATAtgTTATTC CCTCCTTATTCACCTcttAAT GCGTGTTCG | Amplify loxPcat-T5 cassette | 284 |
| TREE136 | AAACGGAGCCTTTCGGCTCCG TTATTCATTTACGCGGCTTCA ACTTTCCGTTATCGGCCCCAG CGGATTG | Amplify BsfabH1 | 285 |
| TREE137 | CGCAGTTTGCAAGTGACGGTA TATAACCGAAAAGTGACTGAG CGTACatgATTCCGGGGATCC GTCGACC | Amplify EcfabH deletion cassette | 286 |
| TREE138 | GCAAATTGCGTCATGTTTTAA TCCTTATCCTAGAAACGAACC AGCGCGGATGTAGGCTGGAGC TGCTTCG | Amplify EcfabH deletion cassette | 287 |
| TREE139 | GCAGCGACAAGTTCCTCAGC | Verify deletion of EcfabH | 288 |
| TREE140 | CCGCAGAAGCTTCAGCAAACG | Verify deletion of EcfabH | 289 |
| fadE-L2 | CGGGCAGGTGCTATGACCAGG AC | Verify integration of BsfabH1 | 290 |
| fadE-R2 | GGGCAGGATAAGCTCGGGAGG | Verify integration of BsfabH1 | 291 |

The loxP-cat-P$_{T5}$-BsfabH1 cassette was integrated using the Red recombinase system (Datsenko, et al., supra). The loxP-cat-P$_{T5}$-BsfabH1 PCR product was used to transform electrocompetent DV2 P$_L$-thrA*BC cells containing plasmid pKD46, which had been previously induced with arabinose for 3-4 hours at 30° C. Following a 3 hour 37° C. outgrowth in SOC medium, cells were plated on Luria agar plates containing 17 µg/mL chloramphenicol and incubated overnight at 37° C. Chloramphenicol-resistent colonies were screened by PCR for proper integration of loxP-cat-$P_{T5}$-BsfabH1. Primers fadE-L2 and fadE-R2 (Table 9) which flank the chromosomal integration site, were used to confirm the integration. Upon verification of integration, the chloramphenicol marker gene was removed by expressing a Cre recombinase which promotes recombination between the two loxP sites that flank the chloramphenicol resistance gene. The plasmid pJW168, which harbors the cre recombinase gene, was transformed into strain DV2 $P_L$-thrA*BC loxP-cat-$P_{T5}$-BsfabH1 and the marker was removed according to the method described by Palmeros et al. (*Gene* 247:255-264 (2000)). The resulting strain DV2 $P_L$-thrA*BC$P_{T5}$-BsfabH1 was verified by sequencing.

DV2 $P_L$-thrA*BC $P_{T5}$-BsfabH1 ΔEcfabH

This example describes the construction of a recombinant *E. coli* cell in which the expression of an undesired endogenous gene (in this instance, the fabH gene of *E. coli*, encoding a beta-ketoacyl-ACP synthase III which utilizes straight-chain acyl-CoA molecules instead of branched-chain acyl-CoA molecules) was attenuated by deletion of that gene.

The fabH gene of *E. coli* was deleted from DV2 $P_L$-thrA*BC $P_{T5}$-BsfabH1 using the Red recombinase system (Datsenko et al., supra). Primers TREE137 and TREE138 (Table 9), were used to amplify the kanamycin resistance cassette from plasmid pKD13 by PCR. The PCR product was then used to transform electrocompetent DV2 $P_L$-thrA*BC $P_{T5}$-BsfabH1 cells containing plasmid pKD46. Deletion of EcfabH and removal of the kanamycin marker were carried out according to the method described by Wanner and Datsenko, supra. Primers TREE139 and TREE140 were used to confirm the deletion of EcfabH. The final markerless strain was named DV2 $P_L$-thrA*BC $P_{T5}$-BsfabH1 ΔEcfabH.

DV2 $P_L$thrA*BC $P_L$-tdcB $P_{T5}$-BsfabH1 ΔEcfabH

A recombinant *E. coli* strain was constructed containing chromosomally-integrated genes overexpressing enzymes of parts (A.1) and (D) of the anteiso-BCFA biosynthetic pathway of FIGS. 3A and 3B. The $P_L$-tdcB mutagenic cassette (prepared as described above) was integrated into strain DV2 $P_L$-thrA*BC $P_{T5}$-BsfabH1 ΔEcfabH to generate the strain DV2 $P_L$-thrA*BC $P_L$-tdcB $P_{T5}$-BsfabH1 ΔEcfabH. In this strain, the integrated *E. coli* thrA*BC genes and the integrated *E. coli* tdcB gene are both under the control of strong lambda $P_L$ promoters, and the integrated *B. subtilis* fabH1 gene is under the control of the strong T5 promoter. The endogenous *E. coli* fadH gene was deleted from this strain.

pOP80 Plasmid

The pOP80 plasmid was constructed by digesting the cloning vector pCL1920 (GenBank AB236930; Lerner C. G. and Inouye M., *Nucleic Acids Res.* 18:4631 (1990)) with the restriction enzymes AflII and SfoI. Three DNA fragments were produced by this digestion. The 3737 bp fragment was gel-purified using a gel-purification kit (Qiagen, Inc., Valencia, Calif.). In parallel, a DNA sequence fragment containing the $P_{Trc}$ promoter and lacI region from the commercial plasmid pTrcHis2 (Invitrogen, Carlsbad, Calif.) was amplified by PCR using primers LF302 (5'-atatgacgtcGGCATCCGCT-TACAGACA-3', SEQ ID NO:292) and LF303 (5'-aattct-taagTCAGGAGAGCGTTCACCGACAA-3', SEQ ID NO:293) introducing the recognition sites for the ZraI and AflII enzymes, respectively. After amplification, the PCR products were purified using a PCR-purification kit (Qiagen, Inc. Valencia, Calif.) and digested with ZraI and AflII following the recommendations of the supplier (New England BioLabs Inc., Ipswich, Mass.). After digestion, the PCR product was gel-purified and ligated with the 3737 bp DNA sequence fragment derived from pCL1920 to generate the expression plasmid pOP80 containing the $P_{Trc}$ promoter.

C. Glutamicum ilvA Plasmid

A plasmid was constructed which expresses the ilvA gene encoding a threonine deaminase from *Corynebacterium glutamicum*, and was tested for its suitability for use in part (A.1) of the anteiso-BCFA biosynthetic pathway of FIG. 3A. The genomic DNA of *Corynebacterium glutamicum* was used to amplify the ilvA gene using the following primers:

```
ilvA_F
                                   (SEQ ID NO: 294)
TAAGGAGGAATAAACCATGAGTGAAACATACGTGTCTGAGA ilvA_R
                                   (SEQ ID NO: 295)
CGGGCCCAAGCTTCGAATTTTATTAGGTCAAGTATTCGTACTCAGGG
```

The gene was inserted into the NcoI and EcoRI sites of plasmid OP80 (above). The plasmid was sequence verified, then transformed into DV2 $P_L$-thrA*BC $P_{T5}$-BsfabH1 ΔEcfabH. This strain was tested for branched fatty acid production against DV2 $P_L$-thrA*BC $P_L$-tdcB $P_{T5}$-BsfabH1 ΔEcfabH, which has an integrated tdcB gene under control of the $P_L$ promoter. The strains were grown in FA-2 media following the protocol outlined below.

Shake Flask Fermentation and Extraction (FA-2 Media Protocol)

Strains were evaluated for branched chain fatty acid production through shake flask fermentation. The standard FA-2 media protocol was generally used. In short, three individual colonies from a transformation were used to inoculate an LB+appropriate antibiotics overnight culture. The following morning, 50 µL of the overnight cultures was used to inoculate 2 mL LB+antibiotics seed cultures. After 3-4 hours of growth, the entire 2 mL LB+antibiotics seed culture was transferred to 18 mL of FA-2 media in 125 mL baffled shake flasks. Cultures were induced with 1 mM IPTG once the $OD_{600}$ reached 1.5 and samples were taken for extraction 20-22 hours post-induction. 400 µL culture samples were acidified with 40 µL 1N HCl and then extracted with 400 µL of butyl acetate spiked with a 500 mg/L C24 alkane internal standard. Extracts were derivatized with an equal volume of N,O-bis(trimethylsilyl)trifluoroacetamide (BSTFA) before being analyzed by GC/MS. The C24 alkane internal standard was used to quantify the free fatty acids (FFA) present in the samples.

TABLE 10

Production of Branched Fatty Acids

| | Strain | Pp bkd pKZ4 | Bs fabH1 | Ec fabH | Total FFA titer | Total BCFA titer | BCFA/ Total FFA | Anteiso- BCFA titer | Anteiso/ total BCFA |
|---|---|---|---|---|---|---|---|---|---|
| 1 | DV2 | + | | p | 2008 | 533 | .27 | 66 | .12 |
| 2 | DV2 thrA*BC | + | | p | 1955 | 535 | .27 | 214 | .40 |

TABLE 10-continued

Production of Branched Fatty Acids

| | Strain | Pp bkd pKZ4 | Bs fabH1 | Ec fabH | Total FFA titer | Total BCFA titer | BCFA/ Total FFA | Anteiso- BCFA titer | Anteiso/ total BCFA |
|---|---|---|---|---|---|---|---|---|---|
| 3 | DV2 thrA*BC | + | int | | 1908 | 651 | .34 | 245 | .38 |
| 4 | DV2 thrA*BC | + | int | Δ | 1563 | 705 | .45 | 255 | .36 |
| 5 | DV2 thrA*BC tdcB | + | p | | 2012 | 589 | .29 | 334 | .57 |
| 6 | DV2 thrA*BC tdcB | + | int | Δ | 1470 | 918 | .62 | 609 | .66 |
| 7 | DV2 thrA*BC Cg ilvA | + | int | Δ | 1257 | 704 | .56 | 513 | .73 | all titers are in milligrams per liter
FFA = free fatty acid;
BCFA = branched chain fatty acid
all strains also express the 'tesA gene on plasmid pACYC-pTrc2-tesA
p = plasmid-expressed BsfabH1 (pDG6)
int = chromosomally integrated BsfabH1 gene
Δ = deleted E. coli chromosomal fabH gene Results:

Comparing strains 1 and 2, increasing the production of the anteiso-BCFA pathway intermediate threonine by overexpressing the thrA*BC genes significantly increased the proportion of anteiso-BCFA produced by the cells; about 12% (by weight) of the BCFA produced by strain 1 were in the anteiso-form, which increased in strain 2 to about 40% of the BCFA produced. On the other hand, the proportion of total BCFA produced by these cells remained fairly constant; about 27% of the FFA produced by each strain was in the branched-chain (BCFA) form.

Comparing strains 2 and 3 shows a slight improvement was obtained by chromosomally integrating a BCFA pathway gene. This example shows an increase in the amount and the proportion of BCFA produced by strain 3, in which the BsfabH1 gene (encoding a polypeptide having branched chain beta-ketoacyl-ACP synthase III activity) was chromosomally integrated, compared to that produced by strain 2 containing the plasmid-expressed BsfabH1 gene. The proportion of anteiso-BCFA produced by the strains containing chromosomally integrated and plasmid-expressed BsFabH1 was relatively unchanged; about 38 to 40% of the total BCFA produced by these strains were anteiso-BCFA.

Comparing strains 3 and 4 demonstrates that attenuating an undesired endogenous gene that directs flux away from the BCFA pathway increases BCFA production. Strain 3 contained the endogenous E. coli fabH gene involved in straight-chain fatty acid production. Deletion of that gene from strain 4 significantly increased the amount of BCFA produced by that strain, increasing from about 34% of the FFA produced in branched form in strain 3, to about 45% of the FFA produced in branched form in strain 4. On the other hand, the proportion of anteiso-BCFA produced by these strains was relatively unchanged; in both of these strains, between 36% to 38% of the total BCFA was produced in the anteiso-form.

Comparing strains 1, 2, 5 and 6 shows that the proportion of anteiso-BCFA produced by a recombinant microbial cell is dramatically increased when cells are engineered to overexpress one more genes encoding endogenous or exogenous polypeptides having activities corresponding to the (A1) part of the anteiso-BCFA pathway. For instance, strain 1 (DV2), which did not overexpress any of the (A1) pathway activities, produced about 12% of BCFA in the anteiso-BCFA form. On the other hand, strain 2 (DV2 thrA*BC), which overexpressed polypeptides having aspartokinase activity, homoserine dehydrogenase activity, homoserine kinase activity, and threonine synthase activity, produced about 40% of BCFA in the anteiso-BCFA form. Strain 2 also shows that the native threonine deaminase activity present in the parental microbial cell was sufficient for production of anteiso-branched chain fatty acids by the anteiso-BCFA pathway shown in FIG. 3A.

Comparing strain 2 and strain 5 demonstrates that, although a native (i.e., unmodified) level of E. coli threonine deaminase activity was sufficient for anteiso-BCFA production in strain 2, increasing that activity by overexpressing an endogenous threonine deaminase enzyme further increased anteiso-BCFA production. While strain 2 produced about 40% of BCFA in the anteiso-form, Strain 5 (DV2 thrA*BC tdcB), which was identical to strain 2 except it also overexpressed a polypeptide having threonine deaminase activity encoded by the E. coli tdcB gene, produced about 57% of BCFA in the anteiso-form.

Comparing strains 5 and 6 further demonstrates the effect of manipulating beta-ketoacyl-ACP synthase III activity (step (D) of the BCFA pathway) on BCFA production. Both strains 5 and 6 overexpress the thrA*BC and tdcB genes. By deleting the endogenous E. coli FabH gene (described above in the context of strain 4) and chromosomally integrating the exogenous BsFabH1 gene (described above in the context of strain 3) the proportion of BCFA produced was nearly doubled, from about 30% of the FFA by strain 5 to over 60% of the FFA by strain 6. In this instance strain 6 also showed an increase in the proportion of anteiso-BCFA produced (from about 57% of BCFA by strain 5, to about 66% of BCFA by strain 6), which was albeit a less dramatic relative increase than in the proportion of BCFA produced.

Comparing strains 6 and 7 demonstrates that an enzyme that catalyzes a particular pathway reaction can be substituted by a different enzyme which catalyzes the same pathway reaction. In this example, an endogenous enzyme encoded by the E. coli tdcB gene that was overexpressed in strain 6 was substituted in strain 7 by an exogenous enzyme encoded by the *C. glutamicum* ilvA gene. The *E. coli* tdcB gene encodes a catabolic threonine deaminase, while the *C. glutamicum* ilvA gene encodes an anabolic threonine deaminase. Both of these enzymes catalyze the conversion of threonine to α-ketobutyrate (i.e., 2-oxobutanoate) and both are classified under EC 4.3.1.19. Although these enzymes are derived from different sources and are encoded by different genes, Table 10 shows that both of these enzymes are suitable for use in a recombinant microbial cell to carry out the conversion of threonine to α-ketobutyrate in the anteiso-BCFA pathway described herein: strain 6 produced about 66% of BCFA in the anteiso-form, while strain 7 produced over 70% of BCFA in the anteiso-form. This result not only confirms that the *C. glutamicum* anabolic threonine deaminase is suitable for use in a recombinant microbial cell to catalyze the conversion of threonine to α-ketobutyrate according to the anteiso-BCFA pathway, it demonstrates that a pathway enzyme (such as, a pathway enzyme described herein) which catalyzes a particular pathway reaction can be "functionally replaced" in the recombinant microbial cell by a different enzyme which catalyzes the same reaction.

Example 5

Engineering *E. coli* for Production of Anteiso-Branched Fatty Acids by Pathway (A.2)

The following example describes the construction of recombinant *E. coli* strains which express exogenous genes and/or overexpress endogenous genes encoding enzymes which serve to increase metabolic flux through the intermediates α-ketobutyrate, the anteiso-branched α-keto acid intermediate α-keto-β-methylvalerate, and the anteiso-branched chain primer 2-methylbutyryl-CoA by the (A.2) part of the BCFA pathway of FIG. 3A, leading to the increased production of anteiso-branched acyl-ACP, and ultimately anteiso-branched fatty acid derivatives, in these recombinant cells.

This example also describes the construction of plasmids which express a fabH gene from *Listeria monocytogenes* and a novel mutant *L. monocytogenes* fabH gene, which provide alternative beta-ketoacyl-ACP synthase III enzymes for part (D) of the BCFA biosynthetic pathways of FIGS. 1 and 3. DV2 $P_{Trc}$-cimA3.7 leuBCD To prepare an *E. coli* strain overexpressing endogenous leuBCD genes and an exogenous cimA3.7 gene, a PCR product was generated for the chromosomal integration of a KmFRT cassette, a $P_{Trc}$ promoter, and cimA3.7 between the endogenous chromosomal *E. coli* leuA and leuB genes. This integration disrupted the native leuABCD operon, placing cimA3.7 and leuBCD in an operon under control of the strong IPTG-inducible promoter, $P_{Trc}$.

DNA encoding CimA3.7 was synthesized by Geneart AG (Regensburg, Germany). The DNA was cloned into the SfiI site of plasmid pMK-RQ (kanR) (Geneart AG, Regensburg, Germany). Flanking the coding sequence, a 5' KpnI restriction site and a 3' SacI restriction site were introduced directly upstream of the ATG start codon and immediately downstream of the TAA stop codon respectively. The cimA 3.7 cloning vector was verified by sequencing.

The individual components of the integration cassette were PCR-amplified as follows. The KmFRT component was amplified from plasmid pKD13 using primers TREE146 and Km_trc_overR (Table 11). The $P_{Trc}$ promoter was amplified from pOP80 (Example 4) using primers Km_trc_overF and TREE033.

The cimA3.7 coding sequence was amplified from the cimA 3.7 cloning vector described above using primers TREE032 and TREE035. To provide the 3' homology sequence for integration, *E. coli* native leuBC genes were amplified using *E. coli* genomic DNA and primers TREE034 and TREE104. The forward primer TREE146, which was used to amplify the KmFRT cassette, included the 5' 50 bp of homology sequence for integration. Each of the primers used to amplify the components contained overlapping sequence which were used to "stitch" the individual pieces together. First, KmFRT and $P_{Trc}$ were stitched together by combining both pieces in a single PCR reaction and using primers TREE146 and TREE033 to amplify the KmFRT-$P_{Trc}$ product. KmFRT-$P_{Trc}$ was then stitched with cimA3.7 using primers TREE146 and TREE035 to generate KmFRT-$P_{Trc}$-cimA3.7. The final piece, leuBC was stitched to KmFRT-$P_{Trc}$-cimA3.7 using primers TREE146 and TREE104 to generate the final integration cassette: KmFRT-$P_{Trc}$-cimA3.7 leuBC.

TABLE 11

Primers

| Primer Name | Primer Sequence (5'→3') | Purpose | SEQ ID NO: |
|---|---|---|---|
| Km_trc_overF | CTTCGAACTGCAGGTCGACG GATCCCCGGAATACATCATA ACGGTTCTGGCGCCG | Amplify pTrc promoter | 296 |
| Km_trc_overR | AATATTTGCCAGAACCGTTA TGATGTCGGCATTCCGGGGA TCCGTCGACC | Amplify KmFRT cassette | 297 |
| TREE032 | GTATATATTAATGTATCGAT TAAATAAGGAGGAATAAACC atgatggtaaggatatttga tacaacac | Amplify cimA3.7 | 298 |
| TREE033 | ctaagtgttgtatcaaatat ccttaccatcatGGTTTATT CCTCCTTATTTAATCGATAC | Amplify pTrc promoter | 299 |
| TREE034 | gatttgttggctatagttag agaagttactggaaaattgT AACAAGGAAACCGTGTGATG TCGAAG | Amplify leuBC | 300 |
| TREE035 | GTAATTCTTCGACATCACAC GGTTTCCTTGTTAcaatttt ccagtaacttctctaactat ag | Amplify cimA3.7 | 301 |
| TREE104 | GGTAGCGAAGGTTTTGCCCG GC | Amplify leuBC | 302 |
| TREE106 | GATTGGTGCCCCAGGTGACC TG | Verify integration | 303 |
| TREE146 | GAGTTGCAACGCAAAGCTCA ACACAACGAAAACAACAAGG AAACCGTGTGaGTGTAGGCT GGAGCTGCTTCG | Amplify KmFRT cassette | 304 |
| TREE151 | CTTCCACGGCGTCGGCCTG | Verify integration | 305 |

The KmFRT-$P_{Trc}$-cimA3.7 leuBC cassette was integrated into the *E. coli* genome using the Red recombinase system (Datsenko et al., supra). The KmFRT-$P_{Trc}$-cimA3.7 leuBC PCR product was used to transform electrocompetent *E. coli* MG1655 DV2 cells containing plasmid pKD46, which had been previously induced with arabinose for 3-4 hours at 30° C. Following a 3-hour 37° C. outgrowth in SOC medium, cells were plated on Luria agar plates containing 50 μg/mL kanamycin and incubated overnight at 37° C. Kanamycin-resistant colonies were screened by PCR for proper integration of KmFRT-P$_{Trc}$-cimA3.7. Primers TREE151 and TREE106, which flank the chromosomal integration site, were used to confirm the integration. Upon verification of integration, the kanamycin marker gene was removed in accordance with the method described by Datsenko et al., supra. Successful integration of P$_{Trc}$-cimA3.7 and removal of the kanamycin marker gene in the final strain, DV2 P$_{Trc}$ cimA3.7 leuBCD, was verified by sequencing.

Strains were transformed with the plasmids pDG6, which expressed BsfabH1; pKZ4, which expressed PpBKD; and pACYC-P$_{Trc2}$-tesA, which expressed the leaderless E. coli 'tesA, as indicated, and tested for branched chain fatty acid production.

A mutant L. monocytogenes fabH gene was discovered containing a T to G change at position 928, resulting in a change in the expressed protein at amino acid position 310 from Tryptophan (W) to Glycine (G), i.e., a W310G variant. The novel mutant L. monocytogenes fabH gene (SEQ ID NO:101) encoding the FabH W310G variant was designated LmFabH2 (SEQ ID NO:100), and the plasmid containing this sequence pTB.081.

Plasmids containing the wild type LmfabH1 gene (pTB.079) and the mutant LmfabH2 gene (pTB.081) were transformed into the DV2 P$_{Trc}$-cimA3.7_leuBCD/pACYCtrc2_tesA strain. The strains were transformed with pKZ4 (*P. putida* BKD) and pDG6 (B subtilis fabH1) plasmids and evaluated for BCFA production.

TABLE 12

Production of Branched Fatty Acids

| | Strains | bkd | fabH | Total FFA titer | Total BCFA titer | BCFA/ Total FFA | Anteiso-BCFA titer | Anteiso/ total BCFA |
|---|---|---|---|---|---|---|---|---|
| 1 | DV2 | Pp | BsH1 | 2008 | 533 | .27 | 66 | .12 |
| 2 | DV2 cimA3.7 leuBCD | (−) | (−) | 3764 | 0 | 0 | 0 | 0 |
| 3 | DV2 cimA3.7 leuBCD | Pp | (−) | 2691 | 6 | .002 | 0 | 0 |
| 4 | DV2 cimA3.7 leuBCD | Pp | BsH1 | 1945 | 522 | .27 | 362 | .69 |
| 5 | DV2 cimA3.7 leuBCD | Pp | LmH | 322 | 122 | .38 | 91 | .75 |
| 6 | DV2 cimA3.7 leuBCD | Pp | LmH2 | 1597 | 419 | .26 | 385 | .92 | all titers are in milligrams per liter
all strains also express the 'tesA gene on plasmid pACYC-$p_{Trc2}$-tesA
FFA = free fatty acid;
BCFA = branched chain fatty acid
Pp = plasmid-expressed BKD operon from *P. putida* (pKZ4)
BsH1 = plasmid-expressed *B. subtilis* FabH1 (pDG6)
LmH1 = plasmid-expressed *L. monocytogenes* FabH1 (pTB.079)
LmH2 = plasmid-expressed *L. monocytogenes* FabH2 W310G (pTB.081)

*L. monocytoqenes* fabH1 and fabH2 (pTB.079 and pTB.081 Plasmids)

The genomic DNA of *Listeria monocytogenes* L123 (ATCC 19114D-5) was used as template to amplify the fabH gene using the following primers:

```
TREE044 (fabH_forward)
                                        (SEQ ID NO: 256)
GAGGAATAAACCATGAACGCAGGAATTTTAGGAGTAG;

primer 61 (fabH_reverse)
                                        (SEQ ID NO: 257)
CCCAAGCTTCGAATTCTTACTTACCCCAACGAATGATTAGG
```

The PCR product was then cloned into the NcoI/EcoRI sites of pDS80 (a pCL1920-based vector carrying the phage lambda $P_L$ promoter; SEQ ID NO:236) and transformed into transformation-competent *E. coli* cells. Individual colonies were picked for sequence verification of cloned inserts. The nucleic acid sequence of wild type *L. monocytogenes* fabH (SEQ ID NO:99) encodes the wild type LmFabH1 protein (SEQ ID NO:98), and the plasmid containing this sequence was designated pTB.079.

Results:

Together with the data described in Example 3 above, strains 2 and 3 of Table 12 demonstrate that little if any BCFA is produced in microbial cells lacking branched chain alpha-keto acid dehydrogenase (BKD) activities and/or beta-ketoacyl-ACP synthase III (e.g., FabH) activity specific for branched-chain substrates, corresponding to steps (C) and (D) of the BCFA pathway of FIG. 1.

Comparing strains 1 and 4 shows the effect of engineering activities corresponding to part (A.2) of the BCFA pathway in recombinant microbial cells on the production of anteiso-BCFA. Strains 1 and 4 produced nearly identical amounts and proportions of BFCA (about 27% of the total FFA produced in these cells were branched fatty acids), however, strain 1 produced primarily iso-BCFA, with only about 12% of the total BCFA being in the anteiso-form. On the other hand, strain 4, expressing genes encoding polypeptides having (R)-citramalate synthase activity, isopropylmalate isomerase activity, and beta-isopropyl malate dehydrogenase activity (corresponding to part (A.2) of the BCFA pathway) produced substantially more anteiso-BCFA, with nearly 70% of the total BCFA in the anteiso-form.

Comparing strains 4, 5 and 6 shows that a variety of polypeptides having branched chain beta-ketoacyl-ACP synthase III activity can be utilized for producing branched chain fatty acids in recombinant microbial cells. More particularly, this example shows that the *L. monocytogenes* wild type FabH and a novel W310G variant of *L. monocytogenes* FabH have activities suitable for use in the BCFA pathway. Comparing FFA produced by cultures of these three strains, which are identical except for the fabH genes employed, shows that strain 5 expressing *B. subtilis* FabH1 produced about 27% of total FFA in branched form, with almost 70% of those branched fatty acids in the anteiso-form; strain 6 expressing wild-type *L. monocytogenes* FabH produced about 38% of total FFA in branched form, with about 75% of those branched fatty acids in anteiso-form; and strain 7 expressing a *L. monocytogenes* W310G variant FabH (designated FabH2) produced about 26% of total FFA in branched form, with, remarkably, over 90% of those branched fatty acids in the anteiso-form.

Example 6

Production of Anteiso-Branched Fatty Acids in *E. coli* by Pathways A.1 and A.2. Combined The following example describes the construction of recombinant *E. coli* strains which express exogenous genes and/or overexpress endogenous genes encoding enzymes which serve to increase metabolic flux through the intermediates α-ketobutyrate, the anteiso-branched α-keto acid intermediate α-keto-β-methylvalerate, and the anteiso-branched chain primer 2-methylbutyryl-CoA by the combined (A.1) and (A.2) parts of the pathway of FIG. 3A, leading to even greater production of anteiso-branched acyl-ACP, and ultimately anteiso-branched fatty acid derivatives, in these recombinant cells.

This example also describes the construction of a plasmid which expresses bkd genes from *Listeria monocytogenes*, which provides another example of branched-chain alpha-keto acid dehydrogenase (BKD) complex enzymes suitable for use in part (C) of the BCFA biosynthetic pathway of FIG. 1.

DV2 $P_L$-thrA*BC $P_{Trc}$-cimA3.7 leuBCD $P_{T5}$-BsfabH1 ΔEcfabH (Strain "G1")

To begin combining the (A.1) and (A.2) parts of the anteiso-BCFA pathway of FIG. 3A, the $P_{Trc}$-cimA3.7_leuBCD cassette (Example 5) was integrated into strain DV2 $P_L$-thrA*BC $P_{T5}$-BsfabH1 ΔEcfabH (Example 4) to generate the strain DV2 $P_L$-thrA*BC $P_{Trc}$-cimA3.7_leuBCD $P_{T5}$-BsfabH1 ΔEcfabH, which was also called strain G1. This strain overexpressed polypeptides having (R)-citramalate synthase activity, isopropylmalate isomerase activity, and beta-isopropyl malate dehydrogenase activity according to the (A.2) part of the anteiso-BCFA pathway, and overexpressed polypeptides having aspartokinase activity, homoserine dehydrogenase activity, homoserine kinase activity, and threonine synthase activity according to the (A.1) part of the part of the anteiso-BCFA pathway.

DV2 $P_L$-thrA*BC $P_L$-tdcB $P_{Trc}$-cimA3.7_leuBCD $P_{T5}$-BsfabH1 ΔEcfabH (Strain "G2")

To create a strain engineered to overexpress polypeptides having activities corresponding to the combined (A.1) and (A.2) parts of the anteiso-BCFA pathway, the $P_L$-tdcB cassette (Example 4) was integrated into strain G1, to generate strain DV2 $P_L$-thrA*BC $P_L$-tdcB $P_{Trc}$-cimA3.7_leuBCD $P_{T5}$-BsfabH1 ΔEcfabH, which was also called strain G2. In this strain, the integrated *E. coli* thrA*BC genes and the integrated *E. coli* tdcB gene (encoding polypeptides having aspartokinase activity, homoserine dehydrogenase activity, homoserine kinase activity, threonine synthase activity, and threonine deaminase activity, corresponding to the (A.1) part of the BCFA pathway) were placed under the control of strong lambda $P_L$ promoters, and were as such overexpressed. The exogenous cimA3.7 gene and the native *E. coli* leuBCD genes (encoding polypeptides having (R)-citramalate synthase activity, isopropylmalate isomerase activity, and beta-isopropyl malate dehydrogenase activity corresponding to the (A.2) part of the BCFA pathway), were also integrated into the *E. coli* chromosome under control of the strong IPTG-inducible promoter $P_{Trc}$ and therefore were also overexpressed. The integrated *B. subtilis* fabH1 gene, encoding a branched chain beta ketoacyl-ACP synthase III corresponding to part (C) the pathway, was under the control of the strong T5 promoter. The endogenous *E. coli* fades gene was deleted from this strain.

Plasmid pTB85 (Expressing the *L. monocytogenes* BKD Complex)

The genomic DNA of *Listeria monocytogenes* L123 (ATCC 19114D-5) was used for amplification of the bkd genes using the following primers:

```
primer81 (BKD_for)
                                  (SEQ ID NO: 306)
GAGGAATAAACCGTGGCAACAGAATATGATGTCGTTATTCT primer82 (BKD_rev)
                                  (SEQ ID NO: 307)
CCCAAGCTTCGAATTTTAATACAATGCTGTATTTTCTTTGGAAAT
```

The Lmbkd PCR product was cloned into the NcoI and EcoRI sites of pGL10.173B (SEQ ID NO:228) under the control of the $P_{trc}$ promoter. The sequence-verified plasmid was transformed into strain G1 (above). The strains were also transformed with pACYC-$P_{Trc}$-tesA (leaderless *E. coli* TesA) pKZ4 (*P. putida* BKD) and pDG6 (*B. subtilis* fabH1) plasmids and evaluated for BCFA production using the FA-2 media protocol as described in Example 4.

Evaluation of BCFA Production

To test for BCFA production, strains DV2 $P_L$-thrA*BC $P_{T5}$-BsfabH1, DV2 $P_L$-thrA*BC $P_{T5}$-BsfabH1 ΔEcfabH, DV2 $P_L$-thrA*BC $P_L$-tdcB $P_{T5}$-BsfabH1 ΔEcfabH, G1, and G2 were transformed with plasmids pKZ4, which expresses PpBKD, and pACYC-$P_{Trc}$-tesA, which expresses the leaderless *E. coli* 'tesA. Strain DV2 $P_L$-thrA*BC transformed with plasmids pKZ4, pACYC-$P_{Trc}$-tesA, and pDG6 (which expresses BsfabH1) served as a control for these experiments. For comparison, fatty acid titers and compositions produced by production strain DV2 and strains engineered to overexpress polypeptides having activities corresponding to the (A.1) pathway or the (A.2) pathway can be found in Tables 10 and 12, above.

TABLE 13

Production of Branched Fatty Acids

| | Strain | bkd | fabH | Total FFA titer | Total BCFA titer | BCFA/ Total FFA | Anteiso- BCFA titer | Anteiso/ total BCFA |
|---|---|---|---|---|---|---|---|---|
| 1 | DV2 thrA*BC | Pp | Int BsH1 ΔEc | 1563 | 705 | .45 | 255 | .36 |
| 2 | DV2 thrA*BC tdcB | Pp | Int BsH1 ΔEc | 1470 | 918 | .62 | 609 | .66 |
| 3 | DV2 thrA*BC cimA3.7 leuBCD (G1) | Pp | Int BsH1 ΔEc | 1483 | 880 | .59 | 741 | .84 |
| 4 | DV2 thrA*BC cimA3.7 leuBCD | Lm | Int BsH1 ΔEc | 830 | 95 | .11 | 83 | .87 |
| 5 | DV2 thrA*BC tdcB cimA3.7 leuBCD (G2) | Pp | Int BsH1 ΔEc | 1429 | 702 | .49 | 633 | .90 | all titers are in milligrams per liter
all strains also express the 'tesA gene on plasmid pACYC-p$_{Trc2}$-tesA
FFA = free fatty acid;
BCFA = branched chain fatty acid
Pp = plasmid-expressed *P. putida* BKD operon
Lm = plasmid-expressed *L. monocytogenes* BKD operon
int BsH1 = chromosomally integrated BsfabH1 gene
ΔEc = deleted *E. coli* chromosomal fabH gene Results:

As was previously noted in Example 4, strain DV2 thrA*BC tdcB (strain 2 in Table 13 above), which overexpressed polypeptides having aspartokinase activity, homoserine dehydrogenase activity, homoserine kinase activity, threonine synthase activity and threonine deaminase activity (according to the (A.1) part of the anteiso-BCFA pathway) and a polypeptide having branched chain beta-ketoacyl-ACP synthase III activity by a chromosomally integrated BsfabH1 gene, produced about two-thirds (66%) of its branched chain fatty acids in the anteiso-form.

Comparing strain 2 to strain 3 (DV2 thrA*BC cimA3.7 leuBCD, also denoted "strain G1"), which overexpressed polypeptides having (R)-citramalate synthase activity, isopropylmalate isomerase activity, and beta-isopropyl malate dehydrogenase activity (according to the (A.2) part of the anteiso-BCFA pathway) in addition to polypeptides having aspartokinase activity, homoserine dehydrogenase activity, homoserine kinase activity, and threonine synthase activity, the amount and proportion of BCFA produced was comparable (about 59% of FFA produced as BCFA in strain 2, compared to about 62% of FFA produced as BCFA in strain 3), but the proportion of anteiso-BCFA was much greater in strain 3 (G1) than in strain 2, such that about 84% of the BCFA produced by strain 3 was in the anteiso-form compared to 66% in strain 2.

Comparing strains 3 and 4 shows the effect of different BKD enzyme complexes on BCFA and anteiso-BCFA production. Strain 3 expressed bkd genes from *P. putida* while strain 4 expressed bkd genes from *L. monocytogenes*. Although the strain expressing the *L. monocytogenes* bkd genes showed a lower overall production (titer) of both FFA and BCFA than the strain expressing the *P. putida* bkd genes, the proportions of anteiso-branched fatty acids produced by these strains were remarkably consistent, with each strain producing about 85% of the branched-chain fatty acids in the anteiso-form.

Comparing strain 3 to strain 5 (DV2 thrA*BC tdcB cimA3.7 leuBCD, also denoted "strain G2"), which is identical to strain 3 except for also overexpressing threonine deaminase, about 90% of the BCFA produced by strain 5 was in the anteiso-form, compared to about 84% in strain 3, which utilized the host cell's native threonine deaminase activity.

Taken together, the data obtained from strain 3 (G1) and strain 5 (G2) indicates that engineering a microbial cell which is capable of producing branched chain fatty acids (owing to the presence of BKD and branched chain beta-ketoacyl-ACP synthase activities) to express or overexpress polypeptides having (R)-citramalate synthase activity, isopropylmalate isomerase activity, and beta-isopropyl malate dehydrogenase activity (according to the (A.2) part of the anteiso-BCFA pathway) together with polypeptides having aspartokinase activity, homoserine dehydrogenase activity, homoserine kinase activity, threonine synthase activity, and optionally threonine deaminase activity (according to the (A.1) part of the anteiso-BCFA pathway) not only results in the production of compositions comprising anteiso-branched chain fatty acids, but compositions in which over 80% of the branched fatty acids produced are in the anteiso-form.

Example 7

Production of Branched Fatty Esters in *E. coli*

To produce branched chain fatty methyl esters and branched chain fatty ethyl esters, *E. coli* strain DV2 (Example 1) is transformed with plasmids pKZ4 (expressing *P. putida* bkd genes), pDG6 (expressing *B. subtilis* fabH1), and a plasmid which expresses the ester synthase polypeptide *Marinobacter hydrocarbonoclasticus* DSM 8798 ester synthase ES9 (GenBank Accession No. AB021021; SEQ ID NO:308)

A polynucleotide encoding ES9 is synthesized by DNA2.0 (Menlo Park, Calif.), is subjected to restriction digestion with BspHI and XhoI, and cloned into plasmid pOP80 (Example 4) also digested with BspHI and XhoI, resulting in a plasmid expressing ES9 under the control of the P Trc promoter.

Individual colonies of DV2 transformed with plasmids pKZ4, pDG6, and the ES9 plasmid are used to inoculate an overnight culture of LB+appropriate antibiotics. The following morning, 50 μL of the overnight cultures are used to inoculate 2 mL LB+antibiotics seed cultures. After 4 h of growth, the cultures are diluted 1:25 in Che-92NBT media containing the appropriate antibiotics and grown overnight. The cultures are diluted in 4NBT to a final OD600 (optical density at 600 nm) of about 0.2. After 6 h of growth, IPTG is added to the culture at a final concentration of 1 mM, and methanol or ethanol to 2% (v/v). At 24 h post-induction, 1 ml of culture is extracted with 500 μl ethyl acetate (containing 1% HCl), derivatized with freshly prepared TMAH and subjected to GC-MS analysis.

An *E. coli* DV2 strain expressing an ES9 ester synthase polypeptide and transformed with plasmids pKZ4 and pDG6, which was cultured essentially as described above and was supplemented with methanol, produced a variety of straight-chain and branched fatty acid methyl esters (FAME). The branched chain FAME detected included iso-$C_1C_{12:0}$, iso-$C_1C_{33:0}$, anteiso-$C_1C_{13:0}$, iso-$C_1C_{14:0}$, iso-$C_1C_{15:0}$, anteiso-$C_1C_{15:0}$, iso-$C_1C_{16:0}$, iso-$C_1C_{17:0}$ and anteiso-$C_1C_{17:0}$ methyl esters. About 31% of the FAME produced were branched FAME. About 74% of the branched FAME were iso-branched FAME and about 26% were anteiso-branched FAME (Table 14).

When the culture was supplemented with ethanol, a variety of straight chain and branched chain fatty acid ethyl esters (FAEE) were produced. The branched chain FAEE detected included iso-$C_2C_{12:0}$, iso-$C_2C_{13:0}$, anteiso-$C_2C_{13:0}$, iso-$C_2C_{14:0}$, anteiso-$C_2C_{15:0}$, iso-$C_2C_{16:0}$, iso-$C_2C_{17:0}$ and anteiso-$C_2C_{17:0}$ ethyl esters. About 22% of the FAEE produced were branched FAEE. About 81% of those branched FAEE were iso-branched FAEE, and about 26% were anteiso-branched FAEE (Table 14).

TABLE 14

Production of Branched Fatty Esters

| | Fatty Ester (FE) produced | Total FE titer | Total Branched Fatty Ester (BFE) titer | BFE/ total FE | Anteiso-BFE titer | Anteiso-BFE/ total BFE |
|---|---|---|---|---|---|---|
| 1 | Fatty acid methyl esters (FAME) | 232 | 73 | 0.31 | 19 | 0.26 |
| 2 | Fatty acid ethyl esters (FAEE) | 325 | 72 | 0.22 | 14 | 0.19 | all titers are in milligrams per liter

Example 8

Production of Branched Fatty Esters in *Bacillus*

*B. subtilis* cells expressing an ester synthase from *Marinobacter hydrocarbonoclasticus* DSM 8798 ester synthase ES9 (GenBank Accession No. ABO21021) produce branched fatty esters.

A polynucleotide sequence encoding the ES9 ester synthase polypeptide (SEQ ID NO:308) is cloned into *B. subtilis* expression vector pHT01 (MoBiTec GmbH, Goettingen, Germany). Vector pHT01 is an *Escherichia coli-Bacillus subtilis* shuttle vector that carries the strong promoter Pgrac for protein expression in *B. subtilis*. The ES9 coding sequence is inserted between the BamHI and XbaI cloning sites. A *B. subtilis* strain 1HA01 (lacA::spec leuB8 metB5 r(−)m(+) Sp; obtained from *Bacillus* Genetic Stock Center, Columbus, Ohio, Strain Number BGSC 1A785) is transformed with pHT01_ES9 according to the protocol of Anagnostopoloulos and Spizizen (*J. Bacteriol.* 1961, 81:741) with the following modifications:

*B. subtilis* 1HA01 cells are grown at 37° C. in the miminal medium as described in Anagnostopoloulos and Spizizen (supra), supplemented with 50 μg/mL methionine (auxotrophic requirements) for 5 hours, until the OD600 reaches 0.6 to 1.0. To each 1 mL culture, 15 μL of plasmid (1-2 μg of DNA) is added and cells are allowed to grow for another 90 minutes at 37° C. Cells are pelleted by centrifugation. The supernatant is removed and discarded and the cells are resuspended in 100 μL LB and plated onto LB agar plates containing 10 μg/mL chloramphenicol. Single colonies are picked from the resulting transformants and used to prepare freezer stocks, and tested for branched fatty ester production.

*B. subtilis* transformed with the pHT01_ES9 vector produces branched methyl esters (when the culture is supplemented with methanol) or branched ethyl esters (when the culture is supplemented with ethanol), including branched esters of C13, C15 and C17 chain lengths.

Example 9

Production of Branched Alkanes in *E. coli*

Branched alkanes are produced by a recombinant microbial cell of the invention which expresses polynucleotides encoding polypeptides having fatty acid derivative enzyme activity, wherein the fatty acid derivative enzyme activity is hydrocarbon biosynthesis activity. The following example demonstrates the production of branched alkanes by a strain which expresses a polypeptide having acyl-ACP reductase (AAR) activity and a polypeptide having aldehyde decarbonylase (ADC) activity. The AAR activity converts the branched acyl-ACP intermediate to a branched aldehyde and the ADC activity converts the branched aldehyde to a branched alkane.

To produce branched alkanes, the *Synechococcus elongatus* PCC7942 aar gene, which encodes a fatty acyl-ACP reductase (GenBank Accession No. YP_400611; SEQ ID NO: 309) was integrated into *E. coli* strain MG1655 ΔfadE ΔtonA (strain DV2; Example 1) to produce strain MG1655 ΔfadE ΔtonA AAR:kan as follows: A polynucleotide encoding the aar gene controlled by a $P_{trc}$ promoter and flanked by a partial lacI gene and a kanamycin resistance cassette was amplified from plasmid pSL67-78A (SEQ ID NO:315) using primers AAR_F (5'-GGCT GGCTGG CATAAAT ATCTC-3'; SEQ ID NO:310) and AAR_R (5'-GTTATGATAT GTTG-GTCGGATA AGCGTCGCGCCGCA TCCGACATTGAT-TGC GAG AGC GTT CAC CGA CAA-3'; SEQ ID NO:311) and integrated between the lacI and lacA genes using the Red recombinase system (Datsenko, et al., supra). The resulting strain was named SL106A. Strain SL106A was transformed with plasmid pTB38, which encodes aldehyde decarbonylase (ADC) from Nostoc punctiforme PCC73102 (GenBank Accession No. YP_001865325; SEQ ID NO: 312) under the control of the $P_{trc}$ promoter and contains a spectinomycin resistance cassette.

The strain was then transformed with plasmids pKZ4 (expressing *P. putida* bkd genes) and pKZ5 (expressing *B. subtilis* fabH1) and evaluated for branched alkane production. The shake flask protocol using Che-9 media (Example 7) was followed. At 24 hour post induction, 1 mL of culture was extracted with 0.5 mL ethyl acetate (containing 1% HCl) and subjected to GC/MS analysis.

A variety of straight chain and branched alkanes were produced (Table 15). The branched alkanes detected included iso-C14:0, anteiso-C14:0, iso-C16:0, and anteiso-C16:0 alkanes. About 14% of the alkanes produced were branched alkanes. About 54% of the branched alkanes were iso-branched alkanes, and about 46% were anteiso-branched alkanes (Table 15).

TABLE 15

Production of Branched Alkanes

| | Strain | Total alkane titer | Total branched chain (BC) alkane titer | BC alkane/ total alkane | Anteiso-BC alkane titer | Anteiso-BC/ total BC alkane titer |
|---|---|---|---|---|---|---|
| 1 | AAR, ADC, BsfabH1, PpBKD | 109 | 15 | 0.14 | 6.9 | 0.46 |

Example 10

Production of Branched Fatty Alcohols in *E. coli*

The *Synechococcus elongatus* PCC7942 Gar gene, which encodes a fatty acyl-ACP reductase (GenBank Accession No. YP_400611; SEQ ID NO: 309) was integrated into the chromosome of *E. coli* strain MG1655 ΔfadE ΔtonA as described in Example 9. The resulting *E. coli* strain MG1655 ΔfadE ΔtonA AAR:kan was transformed with plasmids pKZ4 (expressing *P. putida* bkd genes) and pDG6 (expressing *B. subtilis* fabH1). The strain was evaluated for production of branched chain alcohols using shake flask fermentation.

Figure 7:
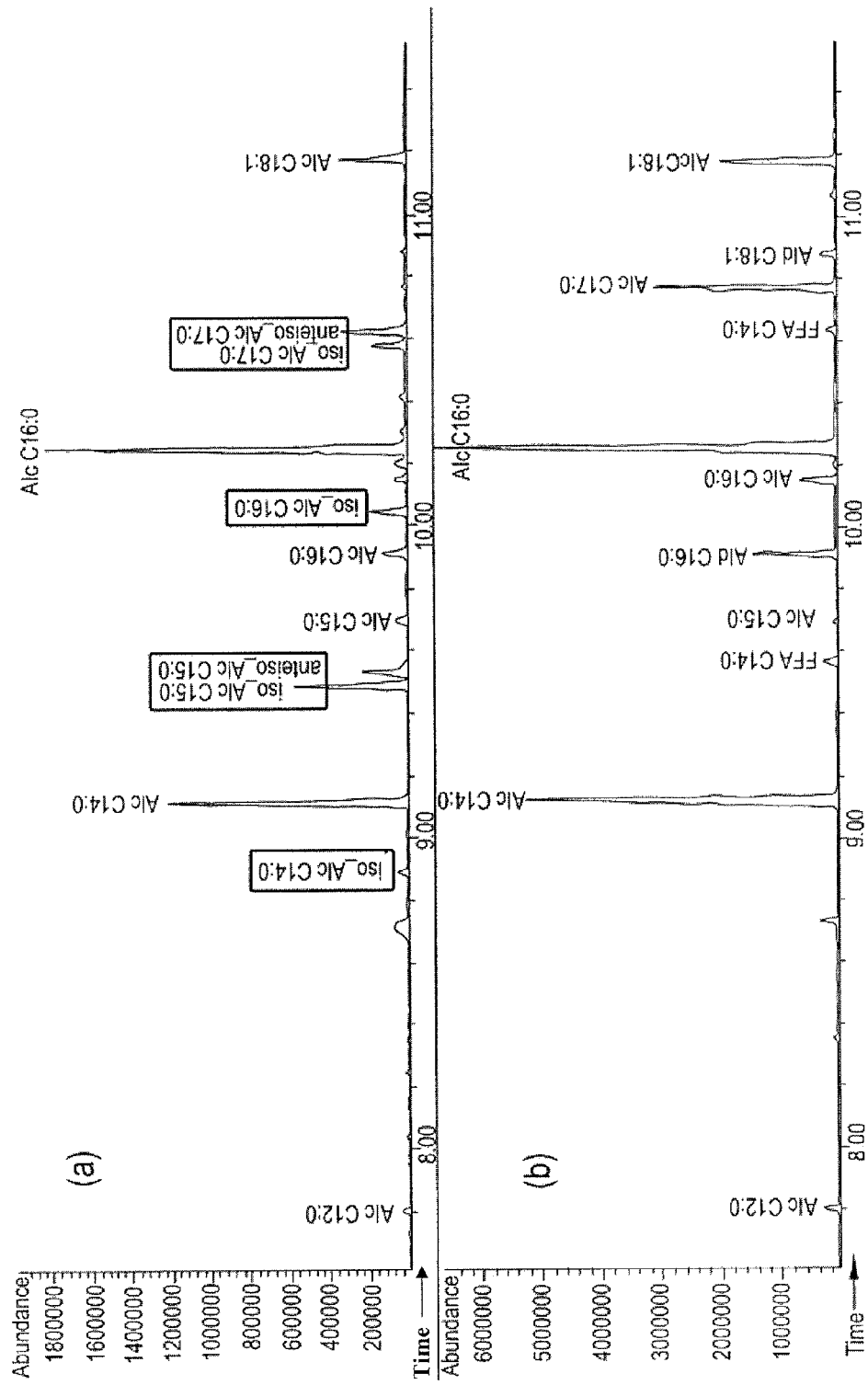
FIG. 7 shows representative GC/MS traces of fatty alcohols produced by E. coli strains expressing (A) S. elongatus AAR, plus plasmids expressing the P. putida BKD complex and B. subtilis FabH1, and (B) the same E. coli strain expressing *S. elongatus* AAR but lacking the plasmids expressing BKD and FabH1. Peaks representing branched fatty alcohols are boxed.

Cultures of *E. coli* MG1655 ΔfadE_ΔtonA AAR:kan without plasmids, or carrying individual plasmids, were used as controls. Seed cultures were grown in LB broth supplemented with the appropriate antibiotics. After 4 hours of growth, the cultures were diluted 1:25 in Che-92NBT medium+appropriate selection marker and grown overnight. The cultures are then diluted in 4NBT to a final OD600 ~0.2. After 6 hours of growth, IPTG was added to a final concentration of 1 mM. At 24 hours post-induction, 1 ml of culture was extracted with 0.5 mL of methyl tert-butyl ether (MTBE) and subjected to GC/MS analysis. FIG. 7(A) shows that iso-branched and anteiso-branched C14-C17 fatty alcohols were produced by the recombinant microbial strain expressing a fatty acyl-ACP reductase (AAR), a branched chain alpha-keto acid dehydrogenase (BKD) complex, and a branched chain-specific β-ketoacyl-ACP synthase III (FabH). FIG. 7(B) shows that branched fatty alcohols were not produced by the recombinant microbial strain expressing AAR but not BDK nor the branched chain-specific FabH.

Example 11

Identification and Quantification of Branched Fatty Acid Derivatives

Instrumentation:

The instrument is an Agilent 5975B MSD system equipped with a 30 m×0.25 mm (0.10 μm film) DB-5 column. The mass spectrometer is equipped with an electron impact ionization source. Two GC/MS programs were utilized.

GC/MS program #1: The temperature of the column is held isothermal at 90° C. for 5 min, then is raised to 300° C. with a 25° C./min ramp, and finally stays at 300° C. for 1.6 min. The total run time is 15 min. With this program, the inlet temperature is hold at 300° C. The injector is set at splitless mode. 1 μL of sample is injected for every injection. The carrier gas (helium) is released at 1.0 mL/min. The source temperature of the mass spectrometer is held at 230° C.

GC/MS program #2: The temperature of the column is held isothermal at 100° C. for 3 min, then is raised to 320° C. with 20° C./min, and finally stays isothermal at 320° C. for 5 min. The total run time is 19 min. The injector is set at splitless mode. 1 μL of sample is injected for every injection. The carrier gas (helium) is released at 1.2 mL/min. The ionization source temperature is set at 230° C.

Samples:

Extracts containing branched fatty acids, branched fatty acid derivatives, and/or branched alkanes produced by the engineered *E. coli* strains were analyzed on GC/MS. As described in Example 7 above, various branched-chain fatty acids, fatty acid derivatives, such as fatty esters, and branched alkanes were detected.

GC/MS Semi-Quantitative Analysis:

In addition to the qualitative analysis, semi-quantitative analysis was performed to obtain the ratio between the branched chain compounds and the straight chain isomers.

Standards:

A mixture of bacterial acid methyl ester (BAME, Sigma-Aldrich, Cat #: 47080-U 10 mg/mL total concentration) contains the following 26 compounds:

Methyl undecanoate
Methyl(±)-2-hydroxydecanoate
Methyl dodecanoate
Methyl tridecanoate
Methyl 2-hydroxydodecanoate
Methyl(±)-3-hydroxydodecanoate
Methyl myristate
Methyl 13-methyltetradecanoate
Methyl 12-methyltetradecanoate
Methyl pentadecanoate
Methyl 2-hydroxytetradecanoate
Methyl 3-hydroxytetradecanoate
Methyl 14-methylpentadecanoate
Methyl cis-9-hexadecenoate
Methyl palmitate Methyl 15-methylhexadecanoate
Methyl cis-9,10-methylenehexadecanoate
Methyl heptadecanoate
Methyl 2-hydroxyhexadecanoate
Methyl linoleate
Methyl oleate
Methyl trans-9-octadecenoate
Methyl stearate
Methyl cis-9,10-methyleneoctadecanoate
Methyl nonadecanoate
Methyl eicosenoate Among these compounds, there are 4 branched FAMEs along with their straight chain isomers: iso-$C_1C_{15:0}$, anteiso-$C_1C_{15:0}$ and n-$C_1C_{15:0}$; iso-$C_1C_{16:0}$ and n-$C_1C_{16:0}$; iso-$C_1C_{17:0}$ and n-$C_1C_{17:0}$. This mixture was diluted 4 fold with ethyl acetate so that each compound in the mixture has a concentration at around 100 mg/L. The diluted mixture was then analyzed by GC/MS to provide qualitative information for all the branched chain acyl compounds produced.

BAME standards were analyzed using GC/MS. The data sheet which provides the GC eluting sequence of all 26 components in the BAME mixture was obtain from a SPB-1 phase column. The retention time (RT) of these compounds analyzed with these two GC programs are listed in the table below. These retention times were used to identify the branched compounds produced by the recombinant microbial strains.

TABLE 16

Retention Times of BAME Standards

| Compounds | RT at GC program #1, min | RT at GC program #2, min |
|---|---|---|
| iso-$C_1C_{15:0}$ | 11.37 | 9.73 |
| anteiso-$C_1C_{15:0}$ | 11.41 | 9.77 |
| n-$C_1C_{15:0}$ | 11.53 | 9.94 |
| iso-$C_1C_{16:0}$ | 11.8 | 10.27 |
| n-$C_1C_{16:0}$ | 12.0 | 10.46 |
| iso-$C_1C_{17:0}$ | 12.21 | 10.79 |
| n-$C_1C_{17:0}$ | 12.36 | 10.97 |

With these retention times, the identification and quantification of the exact compounds measured above were possible. However, the engineered *E. coli* strains were expected to produce branched compounds with chain lengths other than those listed, including, for example, $C_7$, $C_8$, $C_9$, $C_{10}$, $C_{11}$, $C_{12}$, $C_{13}$, or $C_{14}$ compounds. Without commercially available standards, the identification of their structures would have been problematic.

Two approaches were taken. In the first approach, the relative RT of branched chain compounds vs. the straight chain isomers were determined. It was found that the straight chain n-C1C15:0 compound was retained in the column with the longest time, and the iso-C1C15:0 compound was retained in the column with the shortest time among the three isomers. This trend was consistent with the fact that the DB-5 column used in the GC separates volatile compounds based on the boiling point of the compounds. Compounds with higher boiling points typically have longer retention time than compounds with lower boiling points. It was known that the boiling points of branched chain compounds are lower than those of their straight-chain isomer counterparts. This information was used as a qualitative tool to assign the structure of isomers with different chain lengths.

In the second approach, mass spectra of iso-$C_1C_{15:0}$, anteiso-$C_1C_{15:0}$ and n-$C_1C_{15:0}$ isomers were obtained. Because the radical formed by the fragmentation between C12 and C11 is very stable, the spectra of iso- and n-$C_{15:0}$ appeared nearly identical, whereas the spectrum of anteiso-$C_1C_{15:0}$ was substantially different at 199 m/z. Combining the information obtained from the two approaches, the structure of the branched chain products could be reliably predicated.

Using these methods, it was found that the following branched fatty acid branched fatty acid derivatives (e.g., branched fatty acids, alcohols, esters and hydrocarbons) could be detected using GC/MS and the methods described herein (Table 17).

TABLE 17

| | |
|---|---|
| Fatty acid | iso-$C_{12:0}$, iso-$C_{13:0}$, anteiso-$C_{13:0}$, iso-$C_{14:0}$, iso-$C_{15:0}$, anteiso-$C_{15:0}$, iso-$C_{16:0}$, iso-$C_{17:0}$, anteiso-$C_{17:0}$ |
| Fatty alcohol | iso-$C_{14:0}$, iso-$C_{15:0}$, anteiso-$C_{15:0}$, iso-$C_{16:0}$, iso-$C_{17:0}$, anteiso-$C_{17:0}$ |
| FAME | iso-$C_{12:0}$, iso-$C_{13:0}$, anteiso-$C_{13:0}$, iso-$C_{14:0}$, iso-$C_{15:0}$, anteiso-$C_{15:0}$, iso-$C_{16:0}$, iso-$C_{17:0}$, anteiso-$C_{17:0}$ |
| FAEE | iso-$C_{12:0}$, iso-$C_{13:0}$, anteiso-$C_{13:0}$, iso-$C_{14:0}$, iso-$C_{15:0}$, anteiso-$C_{15:0}$, iso-$C_{16:0}$, iso-$C_{17:0}$, anteiso-$C_{17:0}$ |
| 3-OH-FAEE | iso-$C_{13:0}$, anteiso-$C_{13:0}$, iso-$C_{15:0}$, anteiso-$C_{15:0}$ |
| alkane | iso-$C_{14:0}$, anteiso-$C_{14:0}$, iso-$C_{16:0}$, anteiso-$C_{16:0}$ |

Semiquantitative Measurements of Yield

Due to the often lack of commercially available standards for various branched fatty acids, branched fatty acid derivatives and/or branched hydrocarbons, accurate quantitation for the branched chain compounds was challenging. However, by using straight chain standard with the same functional group, the relative quantity or yield of branched-chan compounds in relation to the yield of their straight-chain counterpart (isomers) were estimated semi-quantitatively.

Standard curve quantitation method was applied, wherein standard mixtures with different concentrations were analyzed by the same GC/MS program as the samples. After data acquisition, the instrument response (total ion current) was plotted against the concentrations of the standards. Linear calibration curves were obtained. The concentration of branched alcohols in a given sample was calculated according to the equation y=ax+b, wherein y is the instrument response for a particular compound in a sample. Accordingly, the relative concentration of branched compounds in the production mixture was calculated.

Table 18 lists the fatty methyl esters used as standards to quantify various branched fatty acid methyl esters.

TABLE 18

| FAME compound in sample | Standard used for quantitation |
|---|---|
| iso-$C_1C_{12:0}$ | $C_1C_{12:0}$ |
| $C_1C_{12:0}$ | $C_1C_{12:0}$ |
| Iso-$C_1C_{13:0}$ | $C_1C_{13:0}$ |
| Anteiso-$C_1C_{13:0}$ | $C_1C_{13:0}$ |
| $C_1C_{13:0}$ | $C_1C_{13:0}$ |
| Iso-$C_1C_{14:0}$ | $C_1C_{14:0}$ |
| $C_1C_{14:1}$ | $C_1C_{14:1}$ |
| $C_1C_{14:0}$ | $C_1C_{14:0}$ |
| Iso-$C_1C_{15:0}$ | $C_1C_{15:0}$ |
| Anteiso-$C_1C_{15:0}$ | $C_1C_{15:0}$ |
| $C_1C_{15:0}$ | $C_1C_{15:0}$ |
| Iso-$C_1C_{16:0}$ | $C_1C_{16:0}$ |
| $C_1C_{16:1}$ | $C_1C_{16:1}$ |
| $C_1C_{16:0}$ | $C_1C_{16:0}$ |
| Iso-$C_1C_{17:0}$ | $C_1C_{16:0}$ |
| Anteiso-$C_1C_{17:0}$ | $C_1C_{16:0}$ |
| $C_1C_{18:1}$ | $C_1C_{18:1}$ |
| $C_1C_{18:0}$ | $C_1C_{18:0}$ |

Table 19 lists fatty ethyl esters used as standards to quantify various branched fatty acid ethyl esters.

TABLE 19

| FAEE compound in sample | Standard used for quantitation |
|---|---|
| $C_2C_{8:0}$ | $C_2C_{8:0}$ |
| $C_2C_{10:0}$ | $C_2C_{10:0}$ |
| Iso-$C_2C_{12:0}$ | $C_2C_{12:0}$ |
| $C_2C_{12:1}$ | $C_2C_{12:0}$ |
| $C_2C_{12:0}$ | $C_2C_{12:0}$ |
| Iso-$C_2C_{13:0}$ | $C_2C_{12:0}$ |
| Anteiso-$C_2C_{13:0}$ | $C_2C_{12:0}$ |
| Iso-$C_2C_{14:0}$ | $C_2C_{14:0}$ |
| $C_2C_{14:1}$ | $C_2C_{14:0}$ |
| $C_2C_{14:0}$ | $C_2C_{14:0}$ |
| Iso-$C_2C_{15:0}$ | $C_2C_{14:0}$ |
| Anteiso-$C_2C_{15:0}$ | $C_2C_{14:0}$ |
| Iso-$C_2C_{16:0}$ | $C_2C_{16:0}$ |
| $C_2C_{16:1}$ | $C_2C_{16:0}$ |
| $C_2C_{16:0}$ | $C_2C_{16:0}$ |
| Iso-$C_2C_{17:0}$ | $C_2C_{16:0}$ |
| Anteiso-$C_2C_{17:0}$ | $C_2C_{16:0}$ |
| $C_2C_{18:1}$ | $C_2C_{18:0}$ |
| $C_2C_{18:0}$ | $C_2C_{18:0}$ |

Branched free fatty acids and various other fatty acid derivatives were analyzed using the standard listed below (Table 20):

TABLE 20

| Acyl compounds in sample | Standard used for quantitation |
|---|---|
| straight chain alcohol | $C_{15:0}$ alcohol |
| branched chain alcohol | |
| aldehyde | |
| Free fatty acid | |

Alternatively, a $C_1C_{14:0}$ fatty acid methyl ester was used as a standard for quantitating the derivitized branched free fatty acids in the extract from any production strain (Table 21). The measured concentrations were then converted back to branched free fatty acid concentrations based on their molecular weights.

TABLE 21

| FFA compound in sample (derivatized into FAME) | FAME Standard used for quantitation |
|---|---|
| staight chain FFA | $C_1C_{14:0}$ |
| branched chain FFA | |

Branched alkanes were measured using the following standards (Table 22), which were also used to verify the amount of branched fatty aldehydes or branched fatty alcohols.

TABLE 22

| Alkane, aldehyde and alcohol in sample | Standard used for quantitation |
|---|---|
| Alk $C_{13:0}$ | Alk $C_{12:0}$ |
| Iso-Alk $C_{14:0}$ | Alk $C_{15:1}$ |
| Anteiso-Alk $C_{14:0}$ | Alk $C_{15:1}$ |
| Alk $C_{14:0}$ | Alk $C_{15:1}$ |
| Alk $C_{15:0}$ | Alk $C_{16:1}$ |
| Iso-Alk $C_{16:0}$ | Alk $C_{16:1}$ |
| Anteiso-Alk $C_{16:0}$ | Alk $C_{16:1}$ |
| Ald $C_{14:0}$ | Alc $C_{15:0}$ |
| Alk $C_{16:0}$ | Alk $C_{16:1}$ |
| Alc $C_{16:0}$ | Alc $C_{15:0}$ |
| Alk $C_{17:1}$ | Alk $C_{17:0}$ |
| Iso-Alc $C_{15:0}$ | Alc $C_{15:0}$ |
| Anteiso-Alc $C_{15:0}$ | Alc $C_{15:0}$ |
| Alc $C_{15:0}$ | Alc $C_{15:0}$ |
| Ald $C_{16:0}$ | Alc $C_{15:0}$ |
| Alc $C_{16:0}$ | Alc $C_{15:0}$ |

For a given composition of fatty acid derivative produced, the percentage of the derivative that was produced in the branched chain form was determined according to the equation:

$$\text{Percentage of branched derivative} = 100 \times \frac{\text{(Total branched derivative product in mg/L)}}{\text{(Total branched + straight-chain derivative product in mg/L)}}$$

Likewise, for a given composition of fatty acid derivative produced, the percentage of the branched-chain derivative that was produced in the anteiso-branched chain form was determined according to the equation:

$$\text{Percentage of anteiso-branched derivative} = 100 \times \frac{\text{(Total anteiso-branched derivative product in mg/L)}}{\text{(Total branched derivative product in mg/L)}}$$

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (315 sequences)

SEQ ID NO: 1 - protein, 330 aa, Bacillus subtilis
  MISC_FEATURE: BKD E1alpha subunit
MSTNRHQALGLTDQEAVDMYRTMLLARKIDERMWLLNRSGKIPFVISCQGQEAAQVGAAFALDREMDYVLPYYRDMGVVLAFGMTAKDLMMSGFAKAADPNSGGRQMPGHFGQKKNRIVTGSSPVTTQVPHAVGIALAGRMEKKDIAAFVTFGEGSSNQGDFHEGANFAAVHKLPVIFMCENNKYAISVPYDKQVACENISDRAIGYGMPGVTVNGNDPLEVYQAVKEARERARRGEGPTLIETISYRLTPHSSDDDDSSYRGREEVEEAKKSDPLLTYQAYLKETGLLSDEIEQTMLDEIMAIVNEATDEAENAPYAAPESALDYVYAK

SEQ ID NO: 2 - DNA, 993 bp, Bacillus subtilis
  misc_feature: Encodes BKD E1alpha subunit
ctacttcgcataaacataatcaagcgctgactcaggagctgcatatggggcgttctccgcttcatccgtcgcttcatttacgattgccataatttcatccagcatggtttgttctatctcatcggacagcaggcctgtttcctttaagtaagcttgataagtaagcaggggatcactttttttcgcttcctctacttcttcacggcctctgtagctgctgtcatcgtcatcactggaatgtggtgtaaggcggtaagaaatcgtttcaattaatgtcgggccttctcctctgcgtgccctttcgcgtgcttctttaaccgcttgataaacttccagcggatcatttccattcacagttacgccaggcatcccatagcctatggcacggtcggaaatgttctcacatgcgacttgcttatcgtaaggcactgagattgcgtatttgttgttttcacacatgaaaataaccggcagcttatggacagcggcaaagtttgccccttcatggaaatcgccttggtttgaagacccttccccgaatgtaacaaaggctgcgatatcctttttctccatacgtcccgcaagcgcaataccgactgcgtgcggcacttgcgttgtaaccggagatgatcccgtcacaatgcggtttttcttttgtccgaaatgtcccggcatctggcggcctcctgagttcggatctgctgcttttgcaaacccggacatcattaagtcctttgctgtcatgccaaacgcgagcacgacacccatgtctctgtagtacggcaatacataatccatttcacggtcaagtgcgaaagccgctcctacctgtgctgcttcctgtccttgacaagagattacaaatggaattttgccagaacggtttaacagccacattctttcatcgatttttcttgctaacagcatggttctatacatatcaacggcttcctgatcagtcagccctagtgcttgatgtcggtttgtactcat

SEQ ID NO: 3 - protein, 381 aa, Streptomyces avermitilis
  MISC_FEATURE: BKD E1alpha subunit
MTVMEQRGAYRPTPPPAWQPRTDPAPLLPDALPHRVLGTEAAAEADPLLLRRLYAELVRGRRYNTQATALTKQGRLAVYPSSTGQEACEVAAALVLEERDWLFPSYRDTLAAVARGLDPVQALTLLRGDWHTGYDPREHRIAPLCTPLATQLPHAVGLAHAARLKGDDVVALALVGDGGTSEGDFHEALNFAAVWQAPVVFLVQNNGFAISVPLAKQTAAPSLAHKAVGYGMPGRLVDGNDAAAVHEVLSDAVAHARAGGGPTLVEAVTYRIDAHTNADDATRYRGDSEVEAWRAHDPIALLEHELTERGLLDEDGIRAAREDAEAMAADLRARMNQDPALDPMDLFAHVYAEPTPQLREQEAQLRAELAAEADGPQGVGR

SEQ ID NO: 4 - DNA, 1146 bp, Streptomyces avermitilis
  misc_feature: Encodes BKD E1alpha subunit
atgacggtcatggagcagcggggcgcttaccggcccacaccgccgcccgcctggcagccccgcaccgaccccgcgccactgctgcccgacgcgctgccccaccgcgtcctgggcaccgaggcggccgcggaggccgacccgctactgctgcgccgcctgtacgcggagctggtgcgcggccgccgctacaacacgcaggccacggctctcaccaagcagggccggctcgccgtctacccgtcgagcacgggccaggaggcctgcgaggtcgccgccgcgctcgtgctggaggagcgcgactggctcttccccagctaccgggacaccctcgccgccgtcgcccgcggcctcgatcccgtccaggcgctcaccctcctgcgcggcgactggcacaccgggtacgacccccgtgagcaccgcatcgcgcccctgtgcacccctctcgcgacccagctcccgcacgccgtcggcctcgcgcacgccgcccgcctcaagggcgacgacgtggtcgcgctcgccctggtcggcgacggcggcaccagcgagggcgacttccacgaggcactgaacttcgccgccgtctggcaggcgccggtcgtcttcctcgtgcagaacaacggcttcgccatctccgtcccgctcgccaagcagaccgccgccccgtcgctggcccacaaggccgtcggctacgggatgccgggccgcctggtcgacggcaacgacgcggcggccgtgcacgaggtcctcagcgacgccgtggcccacgcgcgcgcgggaggggggccgacgctcgtggaggcggtgacctaccgcatcgacgcccacaccaacgccgacgacgcgacgcgctaccggggggactccgaggtggaggcctggcgcgcgcacgacccgatcgcgctcctggagcacgagttgaccgaacgcgggctgctcgacgaggacggcatccgggccgcccgcgaggacgccgaggcgatggccgcggacctgcgcgcacgcatgaaccaggatccggccctggaccccatggacctgttcgcccatgtgtatgccgagcccaccccccagctgcgggagcaggaagcccagttgcgggccgagctggcagcggaggccgacgggccccaaggagtcggccgatga

SEQ ID NO: 5 - protein, 410 aa, Pseudomonas putida
  MISC_FEATURE: BKD E1alpha subunit
MNEYAPLRLHVPEPTGRPGCQTDFSYLRLNDAGQARKPAIDVDAADTADLSYSLVRVLDEQGDAQGPWAEDIDPQILRQGMRAMLKTRIFDSRMVVAQRQKKMSFYMQSLGEEAIGSGQALALNRTDMCFPTYRQQSILMARDVSLVEMICQLLSNERDPLKGRQLPIMYSVREAGFFTISGNLATQFVQAVGWAMASAIKGDTKIASAWIGDGATAESDFHTALTFAHVYRAPVILNVVNNQWAISTFQAIAGGESTTFAGRGVGCGIASLRVDGNDFVAVYAASRWAAERARRGLGPSLIEWVTYRAGPHSTSDDPSKYRPADDWSHFPLGDPIARLKQHLIKIGHWSEEEHQAVTAELEAAVIAAQKEAEQYGTLANGHIPSAASMFEDVYKEMPEHLRRQRQELGV

SEQ ID NO: 6 - DNA, 1233 bp, Pseudomonas putida
  misc_feature: Encodes BKD E1alpha subunit
tcaaacccccagttcctggcgttgacggcgcaggtgttcgggcatctccttgtacacatcctcgaacatcgaggcggcgctcgggatgtgcccgttagccagggtgccgtactgctcggcttctttctgtgcggcaatcaccgcagcttcgagctcggccgtgacggcttggtgttcttcttcggaccagtggccgatcttgatcaggtgctgcttcaggcgggcgatcgggtcacccagcgggaagtggctccagtcatcggcagggcggtacttggaggggtcgtccgacgtcgagtgcgggccggcacggtaggtgacccactcgatcaggcttgggcccaggccgcggcgggcgcgctcggcagcccagcgcgaggcggcgtacacggcgacgaagtcgttgccgtcaacccgcagcgaggcaatgccgcagcccacgccacggccggcgaaggtggtcgactcgccaccggcgatggcctggaaggtagaaatcgcccactggttgttgaccacattgaggatcaccggggcgcggtaaacgtgggcaaaggtgagggcggtgtggaagtccgactcggcggtggctccgtcaccgatccacgccgaagcaatcttggtatcgcccttgatcgccgaggccatggcccagccgactgcctgcacgaactgggtcgccaggttgccgctgatggtgaagaagccggcttcgcgcaccgagtacatgatcggcaactggcggcccttgagggggtcgcgctcgttggacagcagttggcagatcatctcgaccagcgatacgtcgcgggccatcaggatgctttgctggcggtaggtcgggaagcacatgtcggtgcggttcagcgccagcgcctggccactgccgatggcttcttcgcccaggctttgcatgtagaaggacatcttcttctggcgctgggcaaccaccatgcggctgtcgaagatccgcgtcttgagcatggcgcgcatgccttgacgaaggatctgtgggtcgatgtcttcggcccaggggccttgcgcatcaccttgctcgtcgagcacgcggaccaggctgtaggacaggtcggcagtgtcggcagcatcgacatcgatcgcgggtttacgggcttgacctgcatcgttgaggcgcaggtaggaaaaatcggtctggcagcctggccggccggtgggctcgggcacatgcaaacgcaggggggcgtactcgttcat

SEQ ID NO: 7 - protein, 331 aa, Listeria monocytogenes
  MISC_FEATURE: BKD E1alpha subunit
MTLKEAGLTEDKLIKMYETMLMARRLDERMWLLNRSGKIPFTISGQGQETAQIGAAFAFDLDKDYALPYYRDLAVVLAFGMTAKDIMLSAFAKAEDPNSGGRQMPAHFGQKSNRIVTQSSPVTTQFPHAAGIGLAAKMAGDEIAIYASTGEGSSNQGDFHEGINFASVHKLPVVFVIHNNQYAISVPASKQYAAEKLSDRAIGYGIPGERVDGTNMGEVYAAFKRAADRARNGEGPTLIETVSYRFTPHSSDDDDSSYRSREEVNEAKGKDPLTIFQTELLEEGYLTEEKIAEIEKNIAKEVNEATDYAESAAYAEPESSLLYVYDEEANS

SEQ ID NO: 8 - DNA, 996 bp, Listeria monocytogenes
  misc_feature: Encodes BKD E1alpha subunit
atgactttaaaagaagcaggtttaacagaagataaattaattaaaatgtatgaaacaatgctaatggcaagaagactagacgagcgtatgtggttgctgaaccgttctgggaaaattcctttcaccatttctggacaaggacaagaaacggcacaaattggcgcagcgtttgcctttgatttagataaagattacgcattaccatattaccgtgatttagcggtggtgttagcatttgggatgacagcgaaagatattatgttatccgcgttcgctaaagcagaggatccaaactctggtggacgtcaaatgccagctcattttggtcaaaaatcaaatcgcatcgtgacacaaagttcaccagtaacaacgcagttcccgcatgcagcaggtattggtcttgcagcgaaaatggccggtgatgagattgcaatttatgcttcaacgggtgaaggatcttctaaccaaggagatttccatgaaggaatcaacttcgcatctgtacataagttgccagttgttttcgtgattcacaataaccaatatgccatttccgttccagcatcgaaacaatatgctgcagaaaaactatccgaccgagcaatcggttatggtatcccaggggaacgtgtggatggcacaaatatgggtgaagtatacgcggcatttaaacgtgcagcagatcgtgcaagaaacggcgagggccccactttaattgaaacagtttcttaccgattcacaccgcactcttctgatgatgatgacagcagttatcgttccagagaagaagtgaacgaagcaaaaggaaaagatccactgacaattttccaaacagaattactcgaagaaggttacttaacagaagaaaaaatcgctgaaatcgaaaaaaatattgcaaaagaagttaacgaagcaaccgattacgcggaaagtgcagcatacgctgaaccagaatcatctttactttatgtatatgatgaagaagcgaatagctga

SEQ ID NO: 9 - protein, 384 aa, Micrococcus luteus
  MISC_FEATURE: BKD E1alpha subunit
MTLVDHTRPTGGQSAGSPPPAGPAEAVMLQVLDTEGRRRPQPELDPWIEDVDAAALAALYRQMAVVRRLDVEATHLQRQGELALWPPLLGQEAAQVGSAVALRPDDFVFPSYRENGVALLRGVPALDLLRVWRGSTFSSWDPNETRVATQQIIIGAQALHAVGYAMGVQRDQADVATIVYFGDGATSQGDVNEAMVFSASYQAPVVFFCQNNHWAISEPVRLQTRRSIADRPWGFGIPSMRVDGNDVLAVLAATRAAVERAADGGGPTFVEAVTYRMGPHTTADDPTRYRDDAELEAWKARDPLTRVEAHLRTLDVDVDAVLAQAQAEADELAAEVRRALEALEEDGADRLFDEIYAEPHQELERQRREHALYLQQFDDEEAGA

SEQ ID NO: 10 - DNA, 1155 bp, Micrococcus luteus
  misc_feature: Encodes BKD E1alpha subunit
gtgaccctcgtggaccacacccgtcccaccggcggacagtccgccggctctccgcccccggcgggcccggccgaggccgtgatgctccaggtgctcgacacggagggccgccgccgtccgcagccggagctcgacccgtggatcgaggacgtcgacgccgccgccctcgccgcgctgtaccgccagatggccgtggtccgtcgcctcgacgtcgaggccacgcacctgcagcgtcagggcgagctggccctgtggccgccgctgctgggccaggaggccgcccaggtgggctccgccgtcgcgctgcgcccggacgacttcgtcttcccgtcctaccgcgagaacggcgtggccctgctgcgcggcgtccccgcgctggacctgctgcgggtgtggcgcggctccacgttctcgagctgggacccgaacgagacgcgggtggccacccagcagatcatcatcggcgcgcaggccctgcacgccgtcggctacgcgatgggcgtccagcgggaccaggcggacgtcgccacgatcgtctacttcggcgacggcgccacgagccagggcgacgtcaacgaggccatggtcttcagcgcctcctaccaggcgcccgtggtgttcttctgccagaacaaccactgggccatctccgagcccgtgcgcctgcagacccgccgcagcatcgcggaccgcccgtggggcttcggcatcccgtcgatgcgcgtggacggcaacgacgtcctggccgtgctcgccgcaacccgcgccgccgtcgagcgcgcggccgacgggggcggccccacgttcgtcgaggccgtcacctaccgcatgggtccacacaccaccgcggacgaccccacccgctaccgggacgacgccgagctcgaggcctggaaggcccgtgacccgctgacccgcgtggaggcgcacctgcgcaccctcgacgtggacgtggacgccgtgcttgcacaggcccaggccgaggccgacgagctggcagcggaggtccgccgtgccctcgaggcgctcgaggaggacggcgcggacaggctcttcgacgagatctacgcggagccccaccaggagctcgagcggcagcgccgcgagcacgccctctacctgcagcagttcgacgacgaggaggcgggcgcgtga

SEQ ID NO: 11 - protein, 330 aa, Staphylococcus aureus
  MISC_FEATURE: BKD E1alpha subunit
MIDYKSLGLSEEDLKVIYKWMDLGRKIDERLWLLNRAGKIPFVVSGQGQEATQIGMAYALEEGDITAPYYRDLAFVTYMGISAYDTFLSAFGKKDDVNSGGKQMPSHFSSRAKNILSQSSPVATQIPHAVGAALALKMDGKKKIATATVGEGSSNQGDFHEGLNFAGVHKLPFVCVIINNKYAISVPDSLQYAAEKLSDRALGYGIHGEQVDGNDPLAMYKAMKEARDRAISGQGSTLIEAVTSRMTAHSSDDDDQYRTKEEREALKKADCNEKFKKELLSAGIIDDAWLAEIEAEHKDIINKATKAAEDAPYPSVEEAYAFVYEEGSLN

SEQ ID NO: 12 - DNA, 993 bp, Staphylococcus aureus
  misc_feature: Encodes BKD E1alpha subunit
ttagttaagactcccttcttcgtacacaaatgcataggcttcttcgacacttggatatggcgcgtcttcagcagcctttgtcgctttattgatgatgtctttatgctccgcttctatttctgccaaccaagcatcatcgataatgccagctgaaagcaactcttttttgaacttttcattgcagtcagcttttttaagcgcttcacgctcttctttcgtacgatattggtcgtcatcatctgatgaatgagctgtcatacgacttgttactgcttcaatcaaagttgaaccttgaccagaaatagctcgatctcttgcttctttcatcgctttatacattgctaatggatcattaccatctacttgttcaccatgtataccgtaaccaagtgctctatccgataatttttcagctgcgtattgtaatgaatcaggtactgaaattgcatatttattatttataatgacacatacaaaaggaagtttgtgtacacccgcgaagtttaaaccttcatggaagtcaccttggtttgagctaccttcaccaacagttgctgttgcaattttcttcttaccatccatttttaaagctaaagcagcaccaacagcatggggtatttgagttgctaccggtgaactttgagacaaaatattcttagctctactactaaagtgtgatggcatttgttttccaccagagttaacatcgtctttctttccaaacgctgataaaaacgtatcatacgctgagatacccatataagtaacgaaagctagatctctataataaggcgctgtaatatcaccttcttctaatgcgtatgccatcccaatctgagttgcttcttgtccttgaccacttacaacaaatggaattttacctgcacggttcaataaccacagtctttcatctatttttctacctaaatccatccatttatatattacttttaggtcttcttcgctaaggcctaatgatttataatcaatcat

SEQ ID NO: 13 - protein, 331 aa, Streptococcus mutans
  MISC_FEATURE: BKD E1alpha subunit
MARKILEVIIAMLSKKQYLDMFLKMQRIRDVDTKLNKLVRRGFVQGMTHFSVGEEAASVGAIQGLTDQDIIFSNHRGHGQTIAKGIDIPAMFAELAGKATGSSKGRGGSMHLANLEKGNYGTNGIVGGGYALAVGAALTQQYDNTGNIVVAFSGDSATNEGSFHESVNLAAVWNLPVIFFIINNRYGISTDINYSTKISHLYLRADAYGIPGHYVEDGNDVIAVYEKMQEVIDYVRSGNGPALVEVESYRWFGHSTADAGAYRTKEEVDAWKAKDPLKKYRTYLTENKIATDEELDMIEKEVAQEIEDAVKFAQDSPEPELSVAFEDVWVD

SEQ ID NO: 14 - DNA, 996 bp, Streptococcus mutans
  misc_feature: Encodes BKD E1alpha subunit
atggcaagaaaaattttggaggtcattatagcaatgttatctaaaaaacaatatttggatatgtttttaaaaatgcagcgtatccgtgatgtcgatacaaaactcaataaattagttcgtcgtggtttcgtacaaggtatgacacacttttcagtaggagaagaggcggcttcggttggtgcgattcaaggcttgactgatcaggatattatcttttcaaatcaccgtggacatggtcaaaccattgcaaaagggattgacattcctgctatgtttgcagaattagccggtaaggcaacgggttcttcaaaaggtcgtggtggttctatgcacttggcaaatcttgaaaaaggaaactatgggaccaatggtattgttggcgggggttatgccttagcagtcggtgctgctttgacacagcaatatgacaatacgggaaatattgttgtcgccttttcaggagactcggcaactaatgaaggctctttccatgagtctgttaatttggcagctgtctggaatttaccggttatcttctttattattaataatcgttatggtatctcaacagatatcaattattctactaagatttcacatctttatttacgtgctgatgcttatggtattcctggacattatgttgaagatggtaatgatgtcattgcagtttatgaaaaaatgcaggaagtcattgattatgtgcgttcaggaaatgggccagctcttgttgaagtggaatcttatcgttggttcggacattctactgctgatgcaggagcttaccgtacaaaagaagaagtagatgcttggaaagctaaagatcctctcaagaaataccgcacttatctaacagaaaataagattgcaacagatgaggaacttgatatgattgaaaaagaagtcgcacaggaaattgaggatgcagtgaaatttgcccaagatagccctgaaccagagctttctgtagcttttgaagatgtttgggtagattag

SEQ ID NO: 15 - protein, 16 aa, Artificial sequence
  Synthetic polypeptide
  MISC_FEATURE: BKD E1alpha motif
  VARIANT (1)..(1): Xaa is Ser or Gln
  VARIANT (2)..(3): Xaa is any amino acid
  VARIANT (5)..(5): Xaa is Gln or Glu
  VARIANT (8)..(10): Xaa is any amino acid
  VARIANT (11)..(11): Xaa is Gly or Ala
  VARIANT (12)..(12): Xaa is any amino acid
  VARIANT (13)..(13): Xaa is Gly or Ala
  VARIANT (14)..(14): Xaa is any amino acid
  VARIANT (15)..(15): Xaa is Val or Ala
  VARIANT (16)..(16): Xaa is Leu or Thr
XXXGXEAXXXXXXXXX

SEQ ID NO: 16 - protein, 8 aa, Artificial sequence
  Synthetic polypeptide
  MISC_FEATURE: BKD E1alpha motif
  VARIANT (2)..(3): Xaa is any amino acid
  VARIANT (4)..(4): Xaa is Leu or Phe
  VARIANT (6)..(6): Xaa is any amino acid
DXXXPXYR

SEQ ID NO: 17 - protein, 11 aa, Artificial sequence
  Synthetic polypeptide
  MISC_FEATURE: BKD E1alpha motif
  VARIANT (1)..(1): Xaa is Ser or Thr
  VARIANT (3)..(4): Xaa is any amino acid
  VARIANT (5)..(5): Xaa is His or Gln
  VARIANT (7)..(7): Xaa is Thr or Val
  VARIANT (9)..(9): Xaa is any amino acid
  VARIANT (11)..(11): Xaa is Ala or Gly
XQXXXAXGXAX

SEQ ID NO: 18 - protein, 20 aa, Artificial sequence
  Synthetic polypeptide
  MISC_FEATURE: BKD E1alpha motif
  VARIANT (1)..(1): Xaa is Lys or Gly
  VARIANT (2)..(2): Xaa is any amino acid
  VARIANT (3)..(3): Xaa is Thr or Asp
  VARIANT (4)..(5): Xaa is any amino acid
  VARIANT (6)..(6): Xaa is Ala or Val
  VARIANT (7)..(7): Xaa is any amino acid
  VARIANT (8)..(8): Xaa is Ala or Val
  VARIANT (9)..(10): Xaa is any amino acid
  VARIANT (12)..(12): Xaa is Glu or Asp
  VARIANT (14)..(17): Xaa is any amino acid
  VARIANT (18)..(18): Xaa is Gly or Ser
  VARIANT (20)..(20): Xaa is Phe or Val
XXXXXXXXXXGXGXXXXXDX

SEQ ID NO: 19 - protein, 21 aa, Artificial sequence
  Synthetic polypeptide
  MISC_FEATURE: BKD E1alpha motif
  VARIANT (2)..(2): Xaa is Ala or Ser
  VARIANT (3)..(3): Xaa is His or Ala
  VARIANT (5)..(6): Xaa is any amino acid
  VARIANT (7)..(7): Xaa is Leu or Ala
  VARIANT (10)..(10): Xaa is any amino acid
  VARIANT (11)..(11): Xaa is Leu or Phe
  VARIANT (12)..(14): Xaa is any amino acid
  VARIANT (17)..(18): Xaa is any amino acid
FXXVXXXPVXXXXXNNXXAIS

SEQ ID NO: 20 - protein, 16 aa, Artificial sequence
  Synthetic polypeptide
  MISC_FEATURE: BKD E1alpha motif
  VARIANT (1)..(1): Xaa is Lys or Arg
  VARIANT (2)..(2): Xaa is Gly or Ala
  VARIANT (3)..(3): Xaa is any amino acid
  VARIANT (5)..(5): Xaa is Cys or Tyr
  VARIANT (6)..(6): Xaa is Phe or Gly
  VARIANT (7)..(7): Xaa is any amino acid
  VARIANT (8)..(8): Xaa is Ala or Pro
  VARIANT (9)..(9): Xaa is Ser or Gly
  VARIANT (10)..(11): Xaa is any amino acid
XXXGXXXXXXXVDGND

SEQ ID NO: 21 - protein, 31 aa, Artificial sequence
  Synthetic polypeptide
  MISC_FEATURE: BKD E1alpha motif
  VARIANT (1)..(1): Xaa is His or Arg
  VARIANT (4)..(4): Xaa is Ala or Arg
  VARIANT (6)..(6): Xaa is any amino acid
  VARIANT (9)..(9): Xaa is any amino acid
  VARIANT (11)..(11): Xaa is any amino acid
  VARIANT (13)..(14): Xaa is any amino acid
  VARIANT (15)..(15): Xaa is Ser or Thr
  VARIANT (18)..(20): Xaa is any amino acid
  VARIANT (22)..(24): Xaa is any amino acid
  VARIANT (27)..(29): Xaa is any amino acid
XARXGXGPXLXEXXXYRXXXHXXXDDXXXYR

SEQ ID NO: 22 - protein, 327 aa, Bacillus subtilis
  MISC_FEATURE: BKD E1beta subunit
MSVMSYIDAINLAMKEEMERDSRVFVLGEDVGRKGGVFKATAGLYEQFGEERVMDTPLAESAIAGVGIGAAMYGMRPIAEMQFADFIMPAVNQIISEAAKIRYRSNNDWSCPIVVRAPYGGGVHGALYHSQSVEAIFANQPGLKIVMPSTPYDAKGLLKAAVRDEDPVLFFEHKRAYRLIKGEVPADDYVLPIGKADVKREGDDITVITYGLCVHFALQAAERLEKDGISAHVVDLRTVYPLDKEAIIEAASKTGKVLLVTEDTKEGSIMSEVAAIISEHCLFDLDAPIKRLAGPDIPAMPYAPTMEKYFMVNPDKVEAAMRELAEF

SEQ ID NO: 23 - DNA, 984 bp, Bacillus subtilis
  misc_feature: Encodes BKD E1beta subunit
ttaaaactccgctaattctctcatcgccgcttccactttatcagggttgaccataaagtatttttccattgtcggcgcataaggcatagccggaatatcaggacctgcaagccgtttgatcggcgcgtctaagtcgaacagacaatgctcggatataattgcggctacttcgctcatgatgctgccttcttttgtatcttctgtgaccaaaagaacctttccagttttggacgcagcttcgatgatggcttctttatcaagcgggtaaactgttcttaaatccaccacatgcgctgaaatgccatctttttcgagacgttctgcagcttgtaaggcgaagtggacacacaggccgtatgtgatcactgtgatgtcgtcgccttccctttttacgtccgccttgccgattggcaggacataatcatcagccggaacctcgccctttatcagacggtatgcccgcttgtgctcaaaaaacagcacggggtcttcgtcacgaactgcggcttttaagagccctttcgcgtcatatggtgttgatggcatgacaattttcagtccgggctggttggcgaaaattgcttcgactgattgagaatgatacagggctccgtgcacgcctccgccgtatggcgctctgacgacaatcggacagctccagtcattgttgctgcggtagcggattttagccgcttcagaaataatttggttgactgccggcataatgaaatcagcaaactgcatttcagcaatcggtctcattccgtacattgccgctccgataccgactcctgcgattgcagattcagcaagcggcgtatccataacgcgctcttccccaaattgttcatagagtcccgctgtcgctttaaacacaccgccttttcttcctacatcttccccaaggacgaaaacgcgagaatctcgttccatttcttctttcatcgccaaattgattgcatcaatatatgacattactgacat

SEQ ID NO: 24 - protein, 334 aa, Streptomyces avermitilis
  MISC_FEATURE: BKD E1beta subunit
MTTVALKPATMAQALTRALRDAMAADPAVHVMGEDVGTLGGVFRVTDGLAKEFGEDRCTDTPLAEAGILGTAVGMAMYGLRPVVEMQFDAFAYPAFEQLISHVARMRNRTRGAMPLPITIRVPYGGGIGGVEHHSDSSEAYYMATPGLHVVTPATVADAYGLLRAAIASDDPVVFLEPKRLYWSKDSWNPDEPGTVEPIGRAVVRRSGRSATLITYGPSLPVCLEAAEAARAEGWDLEVVDLRSLVPFDDETVCASVRRTGRAVVVHESGGYGGPGGEIAARITERCFHHLEAPVLRVAGFDIPYPPPMLERHHLPGVDRILDAVGRLQWEAGS

SEQ ID NO: 25 - DNA, 1005 bp, Streptomyces avermitilis
  misc_feature: Encodes BKD E1beta subunit
atgaccaccgttgccctcaagccggccaccatggcgcaggcactcacacgcgcgttgcgtgacgccatggccgccgaccccgccgtccacgtgatgggcgaggacgtcggcacgctcggcggggtcttccgggtcaccgacgggctcgccaaggagttcggcgaggaccgctgcacggacacgccgctcgccgaggcaggcatcctcggcacggccgtcggcatggcgatgtacgggctgcggccggtcgtcgagatgcagttcgacgcgttcgcgtacccggcgttcgagcagctcatcagccatgtcgcgcggatgcgcaaccgcacccgcggggcgatgccgctgccgatcaccatccgtgtcccctacggcggcggaatcggcggagtcgaacaccacagcgactcctccgaggcgtactacatggcgactccggggctccatgtcgtcacgcccgccacggtcgccgacgcgtacgggctgctgcgcgccgccatcgcctccgacgacccggtcgtcttcctggagcccaagcggctgtactggtcgaaggactcctggaacccggacgagccggggaccgttgaaccgataggccgcgcggtggtgcggcgctcgggccggagcgccacgctcatcacgtacgggccttccctgcccgtctgcctggaggcggccgaggcggcccgggccgagggctgggacctcgaagtcgtcgatctgcgctccctggtgcccttcgacgacgagacggtgtgcgcgtcggtgcgccggaccggacgcgccgtcgtcgtgcacgagtcgggtggttacggcggcccgggcggggagatcgccgcgcggatcaccgagcgctgcttccaccatctggaggcgccggtgctgcgcgtcgccgggttcgacatcccgtatccgccgccgatgctggagcgccatcatctgcccggtgtcgaccggatcctggacgcggtggggcggcttcagtgggaggcggggagctga

SEQ ID NO: 26 - protein, 352 aa, Pseudomonas putida
  MISC_FEATURE: BKD E1beta subunit
MNDHNNSINPETAMATTTMTMIQALRSAMDVMLERDDNVVVYGQDVGYFGGVFRCTEGLQNKYGKSRVFDAPISESGIVGTAVGMGAYGLRPVVEIQFADYFYPASDQIVSELARLRYRSAGEFIAPLTLRMPCGGGIYGGQTHSQSPEAMFTQVCGLRTVMPSNPYDAKGLLIASIECDDPVIFLEPKRLYNGPFDGHHDRPVTPWSKHPHSAVPDGYYTVPLDKAAITRPGNDVTVLTYGTTVYVAQVAAEESGVDAEVIDLRSLWPLDLDTIVESVKKTGRCVVVHEATRTCGFGAELVSLVQEHCFHHLEAPIERVTGWDTPYPHAQEWAYFPGPSRVGAALKKVMEV

SEQ ID NO: 27 - DNA, 1059 bp, Pseudomonas putida
  misc_feature: Encodes BKD E1beta subunit
tcagacctccatgacctttttcagtgccgcacctacccgcgaagggccggggaagtaagcccattcctgtgcgtgagggtagggggtgtcccagccggtgacgcgctcgatcggcgcctccaggtggtggaagcagtgctcctgcaccagcgacaccagctcggcaccgaagccgcaggtgcgggtggcctcgtgcaccaccacgcaacggccagtctttttcaccgactcgacgatagtgtccaggtccagcggccacaggctgcgcaggtcgatcacttcggcatcgacgccgctttcttcggcggccacctgggccacgtacaccgtggtgccgtaagtcagtacggtcacgtcattgccagggcgggtaatggcggccttgtccagcggtacggtgtaatagccgtcgggcacggcgctgtgcgggtgcttcgaccatggggttacagggcggtcgtggtggccatcgaacgggccgttgtacagacgtttgggctccaggaagattaccgggtcgtcgcattcgatcgaggcaatcagcaggcctttggcgtcataagggttggacggcatcacggtgcgcaggccgcagacctgggtgaacatcgcttccgggctctggctgtgagtctggccgccatagatgccgccgccgcaaggcatgcgcagggtcagcggggcaatgaactcgccggccgaccggtaacgcaggcgggccagctcggagacgatctggtcggaggccgggtagaagtagtcggcgaactggatctccaccaccgggcgcaggccataggcgcccatgcctacggcggtaccgacgatgccgctctcggagatgggcgcgtcgaacacgcgcgatttgccgtacttgttctgcaggccttcggtgcagcggaacacgccgccgaagtaaccgacgtcctggccgtacaccaccacattgtcgtcgcgctcaagcatgacatccatggccgagcgcagggcctggatcatggtcatggtagtggtggccatggcggtttccgggttgatgctgttgttgtggtcgttcat

SEQ ID NO: 28 - protein, 327 aa, Listeria monocytogenes
  MISC_FEATURE: BKD E1beta subunit
MPVISYIDAITMALKEEMERDDKVFILGEDVGKKGGVFKATAGLYDEFGEDRVLDTPLAESAIAGVGIGAAMYGYRPVAEMQFADFIMPAVNQIISEAARIRYRSNNDWSCPMVIRAPFGGGVHGALYHSQSVEKVFFGQPGLKIVVPSSPYDAKGLLKAAIRDNDPVLFFEHKRAYRLLKGEVPETDYIVPIGEANVVREGDDITVITYGLAVQFAQQAAERLAAEGVEAHILDLRTIYPLDQEAIIEATKKTGKVLLVTEDNKQGSIISEVAAIISEHCLFDLDAPIARLAGPDTPAMPFAPTMEKHFMINPDKVADAMKELAEF

SEQ ID NO: 29 - DNA, 984 bp, Listeria monocytogenes
  misc_feature: Encodes BKD E1beta subunit
atgccagtcatttcatatattgatgcaataaccatggcgcttaaagaagaaatggagcgcgatgataaagtatttattttaggagaagatgttgggaaaaaaggtggcgtatttaaagcgactgctggtctatatgacgaatttggtgaagacagagtacttgatacaccacttgctgaatctgccattgccggagttggaattggcgcggcgatgtatggctaccgcccagttgcagaaatgcaatttgctgactttattatgccagctgtcaaccaaatcatttcagaagctgccagaattcggtaccgttctaataacgattggtcttgtccaatggttattcgcgcaccttttggcggcggggtacacggggcactttaccattcacaatctgttgaaaaagtgtttttcggacaacctggtttgaaaatcgttgttccttcttcaccatatgatgcaaaagggcttttaaaagcggcgattcgcgataatgatccagtgcttttctttgagcataaacgtgcgtaccgcttgctaaaaggcgaagtgccagaaactgattatatcgttccaatcggcgaagcaaatgttgttcgtgaaggtgatgatattacagtaattacttacggacttgcggttcaatttgcccaacaagcagcagaacgtttagcagcggaaggcgtagaagcacatattcttgatttacggacaatctatccactagaccaagaagcaattattgaagcaacgaaaaaaacaggtaaagtacttcttgtaacggaagataacaaacaaggaagtattatcagtgaagtggcagcaatcatttcggagcattgtttatttgacttagacgcaccgattgctagactcgcaggacctgataccccagcgatgccttttgctccaacaatggaaaaacattttatgatcaatccagataaagtggcggatgcaatgaaagaattagcggaattttag

SEQ ID NO: 30 - protein, 355 aa, Micrococcus luteus
  MISC_FEATURE: BKD E1beta subunit
MSERMTFGRAINRGLHRALADDPKVLLMGEDIGALGGVFRITDGLQAEFGEDRVLDTPLAESGIVGTAIGLAMRGYRPVVEIQFDGFVYPAFDQIVANLAKLRARTRGAVPMPVTIRIPFGGGIGSPEHHSESPEAYFLHTAGLRVVSPSSPQEGYDLIRAAIASEDPVVYLEPKRRYHDKGDVDLGVAIPPMSPARILREGRDATLVAYGPLVKTALQAAEVAAEEGVEVEVVDLRSLSPLDTGLVESSVRRTGRLVVAHEASRTGGLGAELVATVAERAFHWLEAPPVRVTGMDVPYPPSKLEHLHLPDLDRILDGLDRALGRPNSLDSVDAFAAPETAEQFLAAQNAGEETR

SEQ ID NO: 31 - DNA, 1068 bp, Micrococcus luteus
  misc_feature: Encodes BKD E1beta subunit
gtgagcgagcgcatgaccttcggccgtgcgatcaaccgcggcctgcaccgtgccctggccgacgaccccaaggtcctgctcatgggcgaggacatcggcgccctcggcggcgtgttccgcatcaccgacggcctgcaggccgagttcggcgaggaccgggtgctcgacaccccgctggccgagtccggcatcgtgggcacggccatcggcctggcgatgcgcggctaccggcccgtcgtcgagatccagttcgacggcttcgtgtacccggcgttcgaccagatcgtggcgaacctggccaagctgcgcgcccgcacccgcggcgccgtgccgatgccggtgaccatccgcatccccttcggcggcggcatcggctccccggagcaccactccgagtcgcccgaggcctacttcctgcacaccgcgggtctgcgcgtggtctccccgtcctccccgcaggaggggtacgacctcatccgcgccgcgatcgcctcggaggacccggtggtctacctcgagcccaagcgtcgctaccacgacaagggcgacgtggacctgggcgtcgcgatcccgccgatgagcccggcccgcatcctgcgcgagggccgtgacgccacgctcgtggcctacggcccgctcgtgaagaccgccctgcaggccgccgaggtggcggccgaggagggtgtcgaggtcgaggtggtcgacctgcgcagcctgtccccgctggacaccggcctcgtcgagtcctcggtgcggcgcaccggtcggctcgtcgtggcgcacgaggcctcccgcacgggcggcctcggcgccgagctcgtggccacggtggccgagcgcgcgttccattggctcgaggccccgccggtgcgcgtcaccggcatggacgtgccctacccgccgtccaagctcgagcacctgcacctgccggacctcgaccgcatcctcgacggcctggaccgtgctctgggccggccgaattcgctggactccgtggacgcgttcgccgcccccgagaccgccgagcagttcctcgccgcccagaacgccggggaggagacccgatga

SEQ ID NO: 32 - protein, 327 aa, Staphylococcus aureus
  MISC_FEATURE: BKD E1beta subunit
MAKLSYLEAIRQAQDLALQQNKDVFILGEDVGKKGGVFGTTQGLQQQYGEDRVIDTPLAESNIVGTAIGAAMVGKRPIAEIQFADFILPATNQIISEAAKMRYRSNNDWQCPLTIRAPFGGGVHGGLYHSQSIESIFASSPGLTIVIPSTPYDAKGLLLSSIESNDPVLYFEHKKAYRFLKEEVPEEYYTVPLGKADVKREGEDLTVFCYGLMVNYCLQAADILAADGINVEVVDLRTVYPLDKETIIDRAKNTGKVLLVTEDNLEGSIMSEVSAIIAEHCLFDLDTPIMRLAAPDVPSMPFSPVLENEIMMNPEKILNKMRELAEF

SEQ ID NO: 33 - DNA, 984 bp, Staphylococcus aureus
  misc_feature: Encodes BKD E1beta subunit
ctagaattctgctaattcacgcattttatttaagattttttctggattcatcataatttcattttctaatacaggagaaaatggcatagatggtacatctggagcagctaaacgcatgattggtgtatctaaatcgaacaagcaatgctctgcaataatcgctgacacttctgacataatactaccttctaaattatcttcagttacaagtaaaactttacctgtatttttagcacgatcaataattgtttctttatctaatggataaacagttcgtaaatcaacgacttcaacgttgataccgtctgcagctaaaatatccgctgcttgtaaacaataattgaccattaatccataacaaaatactgttaaatcttcaccttcacgtttaacatctgcttttcctaaaggtacagtgtaatattcttctggcacttcttcctttaagaaacgataagcttttttatgctcaaagtacaatactggatcatttgattcgatagatgataataaaagccctttagcatcatacggtgtggaaggaataacaattgttaaacctggtgatgaagcaaatatactttcaatactttgtgaatgatatagtcctccgtgaacaccgccaccaaatggtgcacgaatcgttaatgggcattgccaatcattatttgaacgataacgcattttcgcagcttcactaataatttgatttgtcgcaggtaaaataaaatctgcaaattgaatttctgcaattggtcttttacctaccatagctgcaccaatggcagttccaacaatatttgactcagctaatggcgtatcgataactctgtcttcaccatattgttgttgtagtccttgagtagtaccaaatacgccaccttttttaccaacatcttcaccaagaataaacacatctttattttgttgtaatgctaagtcttgtgcctggcgtatcgcctctaaataagataatttagccat

SEQ ID NO: 34 - protein, 337 aa, Streptococcus mutans
  MISC_FEATURE: BKD E1beta subunit
MRRKRYMSETKVVALREAINLAMSEEMRKDEKIILMGEDVGIYGGDFGTSVGMLAEFGEKRVKDTPISEAAIAGSAVGAAQTGLRPIVDLTFMDFVTIAMDAIVNQGAKANYMFGGGLKTPVTFRVASGSGIGSAAQHSQSLEAWLTHIPGIKVVAPGTVNDAKALLKSAIRDNNIVIFMEPKALYGKKEEVNLDPDFYIPLGKGEIKREGTDVTIVSYGRMLERVLKAAEEVAAEDISVEVVDPRTLIPLDKDLIINSVKKTGKVILVNDAYKTGGFIGEIASVITESEAFDYLDAPVLRLASEDVPVPYSHVLETAILPDVAKIKEAIYKQVRKR

SEQ ID NO: 35 - DNA, 1014 bp, Streptococcus mutans
  misc_feature: Encodes BKD E1beta subunit
atgaggagaaagagatatatgtcagaaacaaaagtagtagccttacgggaagctatcaatcttgctatgagcgaggaaatgcgtaaggacgaaaaaattattttgatgggtgaagatgtcggtatttatggtggtgactttggaacttctgttggtatgctggctgaatttggtgaaaagcgtgttaaagatacccctatttcagaagcagccattgcaggatctgcagtaggtgccgctcaaactggacttcgtcctattgttgatttgacctttatggactttgtgactattgccatggatgctattgttaatcaaggtgctaaagccaattatatgtttggcggcggacttaaaacgcctgtaacctttcgtgtggcctcaggctcaggtatcggctcagcagcgcagcattctcagtcactagaagcttggttaactcatattccgggaatcaaggtggttgcgcctggcacagtcaatgatgctaaagccttgctcaaatctgctattcgtgataataatatcgttattttcatggaaccaaaagcgctttatggcaaaaaagaagaggtcaatttagatcctgatttttatattccgcttggtaaaggcgaaattaagcgcgagggaacagatgttaccattgtgtcttatggtcgtatgctggaacgcgttctcaaagccgctgaggaagtggcggctgaagatatcagtgttgaagttgttgacccgcgtacccttattccgcttgataaagacttaattattaattctgtgaaaaagacgggtaaggttatcctagttaatgatgcttataaaacaggtggtttcattggtgaaatagcatcagtgattactgaaagcgaagcatttgattatttagatgcaccagtgcttcgtctcgcttctgaggatgtgcctgttccctattctcatgttctcgaaacagccattttaccagatgtggcaaaaattaaagaagctatctataaacaagtcaggaaaagatag

SEQ ID NO: 36 - protein, 21 aa, Artificial sequence
  Synthetic polypeptide
  MISC_FEATURE: BKD E1beta motif
  VARIANT (2)..(2): Xaa is any amino acid
  VARIANT (3)..(3): Xaa is Val or Ile
  VARIANT (4)..(4): Xaa is any amino acid
  VARIANT (6)..(6): Xaa is Gln or Glu
  VARIANT (10)..(11): Xaa is any amino acid
  VARIANT (16)..(16): Xaa is Arg or Lys
  VARIANT (17)..(17): Xaa is any amino acid
  VARIANT (19)..(19): Xaa is any amino acid
VXXXGXDVGXXGGVFXXTXGI

SEQ ID NO: 37 - protein, 16 aa, Artificial sequence
  Synthetic polypeptide
  MISC_FEATURE: BKD E1beta motif
  VARIANT (1)..(1): Xaa is Tyr or Phe
  VARIANT (3)..(3): Xaa is Glu or Lys
  VARIANT (4)..(4): Xaa is any amino acid
  VARIANT (6)..(6): Xaa is Cys or Val
  VARIANT (7)..(7): Xaa is any amino acid
  VARIANT (9)..(9): Xaa is Ala or Thr
  VARIANT (11)..(11): Xaa is Leu or Ile
  VARIANT (12)..(12): Xaa is Ala or Ser
  VARIANT (14)..(14): Xaa is Ala or Ser
  VARIANT (15)..(15): Xaa is Ala or Gly
XGXXRXXDXPXXEXXI

SEQ ID NO: 38 - protein, 15 aa, Artificial sequence
  Synthetic polypeptide
  MISC_FEATURE: BKD E1beta motif
  VARIANT (3)..(3): Xaa is Ala or Glu
  VARIANT (4)..(4): Xaa is any amino acid
  VARIANT (5)..(5): Xaa is Arg or Tyr
  VARIANT (7)..(7): Xaa is any amino acid
  VARIANT (10)..(10): Xaa is Ile or Val
  VARIANT (11)..(11): Xaa is Ala or Val
  VARIANT (13)..(13): Xaa is any amino acid
GTXXXGXRPXXEXQF

SEQ ID NO: 39 - protein, 19 aa, Artificial sequence
  Synthetic polypeptide
  MISC_FEATURE: BKD E1beta motif
  VARIANT (2)..(2): Xaa is Cys or Tyr
  VARIANT (5)..(5): Xaa is Val or Ile
  VARIANT (6)..(6): Xaa is any amino acid
  VARIANT (7)..(7): Xaa is Ala or Gly
  VARIANT (8)..(10): Xaa is any amino acid
  VARIANT (13)..(13): Xaa is any amino acid
  VARIANT (15)..(15): Xaa is any amino acid
  VARIANT (18)..(18): Xaa is any amino acid
  VARIANT (19)..(19): Xaa is Phe or Tyr
PXGGXXXXXXHSXSXEAXX

SEQ ID NO: 40 - protein, 13 aa, Artificial sequence
  Synthetic polypeptide
  MISC_FEATURE: BKD E1beta motif
  VARIANT (1)..(1): Xaa is Glu or Asp
  VARIANT (5)..(5): Xaa is any amino acid
  VARIANT (6)..(6): Xaa is Phe or Tyr
  VARIANT (7)..(7): Xaa is any amino acid
  VARIANT (9)..(9): Xaa is His or Pro
  VARIANT (12)..(12): Xaa is any amino acid
XDPVXXXEXKRXY

SEQ ID NO: 41 - protein, 12 aa, Artificial sequence
  Synthetic polypeptide
  MISC_FEATURE: BKD E1beta motif
  VARIANT (1)..(1): Xaa is His or Glu
  VARIANT (3)..(3): Xaa is Ile or Val
  VARIANT (7)..(7): Xaa is Thr or Ser
  VARIANT (8)..(9): Xaa is any amino acid
  VARIANT (11)..(11): Xaa is any amino acid
XVXDLRXXXPXD

SEQ ID NO: 42 - protein, 19 aa, Artificial sequence
  Synthetic polypeptide
  MISC_FEATURE: BKD E1beta motif
  VARIANT (2)..(2): Xaa is any amino acid
  VARIANT (4)..(4): Xaa is Leu or Phe
  VARIANT (5)..(5): Xaa is any amino acid
  VARIANT (6)..(6): Xaa is Asp or His
  VARIANT (8)..(8): Xaa is Asp or Glu
  VARIANT (11)..(12): Xaa is any amino acid
  VARIANT (14)..(14): Xaa is Leu or Val
  VARIANT (15)..(15): Xaa is any amino acid
  VARIANT (17)..(17): Xaa is any amino acid
  VARIANT (18)..(18): Xaa is His or Asp
EXCXXXLXAPXXRXXGXXP

SEQ ID NO: 43 - protein, 424 aa, Bacillus subtilis
  MISC_FEATURE: BKD E2 component
MAIEQMTMPQLGESVTEGTISKWLVAPGDKVNKYDPIAEVMTDKVNAEVPSSFTGTITELVGEEGQTLQVGEMICKIETEGANPAEQKQEQPAASEAAENPVAKSAGAADQPNKKRYSPAVLRLAGEHGIDLDQVTGTGAGGRITRKDIQRLIETGGVQEQNPEELKTAAPAPKSASKPEPKEETSYPASAAGDKEIPVTGVRKAIASNMKRSKTEIPHAWTMMEVDVTNMVAYRNSIKDSFKKTEGFNLTFFAFFVKAVAQALKEFPQMNSMWAGDKIIQKKDINISIAVATEDSLFVPVIKNADEKTIKGIAKDITGLAKKVRDGKLTADDMQGGTFTVNNTGSFGSVQSMGIINYPQAAILQVESIVKRPVVMDNGMIAVRDMVNLCLSLDHRVLDGLVCGRFLGRVKQILESIDEKTSVY

SEQ ID NO: 44 - DNA, 1275 bp, Bacillus subtilis
  misc_feature: Encodes BKD E2 component
ttagtaaacagatgtcttctcgtcaatcgattctaaaatttgtttcactcgtccgaggaatcgtccgcacacgagaccgtcaagcactctgtgatctaatgacaggcacagattaaccatgtctctgacagcaatcatgccattgtccatgacaaccgggcgtttgacgatggattctacttgaagaatcgcagcctgagggtagttgataatgcccatcgactgaacagacccgaacgaacctgtgttgttgacggtaaacgtgcctccctgcatgtcatctgcagtgagttttccgtctcttacttttttagctaggccggtaatgtctttcgcaatgcctttaattgttttttcatcagcgtttttaatcaccggaacaaataaagaatcctctgtggcaactgcaattgaaatattgatatcctttttctgaataattttgtcccccgcccacatgctattcatttgcgggaattcttttaacgcctgagcgaccgcttttacaaaaaaggcgaagaacgttaaattaaagccttctgtcttcttaaaagaatcttttatactgttgcgatatgcaaccatatttgtgacgtcgacttccatcatcgtccaagcatgcggaatttctgttttgcttcgcttcatattggaagcaattgcttttcttacacctgtgacagggatttctttatcaccggctgcagacgcaggatatgacgtctcttcttttggctcaggttttgatgcagacttcggtgcaggagctgctgttttcagctcctcaggattctgttcttgcacgccgcctgtttcaattaagcgctgaatatcttttcgtgtgatgcgcccgccggcaccagttcctgtcacttgatcgaggtcaatgccgtgctctccggccaaacggagaacagctggcgagtagcgctttttattgggctgatcggctgctccagcactttttgcaacagggttctcagcggcttctgatgctgctggctgttcttgtttttgttcagccggattcgcgccttctgtttcaattttgcaaatcatttctccgacttgcagggtttggccttcttctcccacaagctctgttatcgtaccagtaaaagaagacggaacctctgcatttaccttatctgtcatgacttccgcgatcggatcgtatttgttcactttatcaccgggggcgacaagccatttgctgatcgtcccctctgttacgctttctccaagctgcggcatcgtcatttgttcaattgccat

SEQ ID NO: 45 - protein, 455 aa, Streptomyces avermitilis
  MISC_FEATURE: BKD E2 component
MAQVLEFKLPDLGEGLTEAEIVRWLVQVGDVVAIDQPVVEVETAKAMVEVPCPYGGVVTARFGEEGTELPVGSPLLTVAVGAPSSVPAASSLSGATSASSASSVSSDDGESSGNVLVGYGTSAAPARRRRVRPGQAAPVVTATAAAAATRVAAPERSDGPVPVISPLVRRLARENGLDLRALAGSGPDGLILRSDVEQALRAAPTPAPTPTMPPAPTPAPTPAAAPRGTRIPLRGVRGAVADKLSRSRREIPDATCWVDADATALMHARVAMNATGGPKISLIALLARICTAALARFPELNSTVDMDAREVVRLDQVHLGFAAQTERGLVVPVVRDAHARDAESLSAEFARLTEAARTGTLTPGELTGGTFTLNNYGVFGVDGSTPIINHPEAAMLGVGRIIPKPWVHEGELAVRQVVQLSLTFDHRVCDGGTAGGFLRYVADCVEQPAVLLRTL

SEQ ID NO: 46 - DNA, 1368 bp, Streptomyces avermitilis
  misc_feature: Encodes BKD E2 component
atggcccaggtgctcgagttcaagctccccgacctcggggagggcctgaccgaggccgagatcgtccgctggctggtgcaggtcggcgacgtcgtggcgatcgaccagccggtcgtcgaggtggagacggccaaggcgatggtcgaggtgccgtgcccctacgggggcgtggtcaccgcccgcttcggcgaggagggcacggaactgcccgtgggctcaccgctgttgacggtggctgtcggagctccgtcctcggtgcccgcggcgtcctcgctgtccggggcgacatcggcgtcctccgcgtcctcggtgtcatcggacgacggcgagtcgtccggcaacgtcctggtcggatacggcacgtcggccgcgcccgcgcgccggcggagggtgcggccgggccaggcggcacccgtggtgacggcaactgccgccgcggccgccacgcgcgtggcggctcccgagcggagcgacggccccgtgcccgtgatctccccgctggtccgcaggctcgcccgggagaacggcctggatctgcgggcgctggcgggctccgggcccgacgggctgatcctgaggtcggacgtcgagcaggcgctgcgcgccgcgcccactcctgcccccaccccgaccatgcctccggctcccactcctgcccccacccccgccgcggcaccccgcggcacccgcatccccctccgaggggtccgcggtgccgtcgccgacaaactctcccgcagccggcgtgagatccccgacgcgacctgctgggtggacgccgacgccacggcactcatgcacgcgcgcgtggcgatgaacgcgaccggcggcccgaagatctccctcatcgcgctgctcgccaggatctgcaccgccgcactggcccgcttccccgagctcaactccaccgtcgacatggacgcccgcgaggtcgtacggctcgaccaggtgcacctgggcttcgccgcgcagaccgaacgggggctcgtcgtcccggtcgtgcgggacgcgcacgcgcgggacgccgagtcgctcagcgccgagttcgcgcggctgaccgaggccgcccggaccggcaccctcacacccggggaactgaccggcggcaccttcacgttgaacaactacggggtgttcggcgtcgacggttccacgccgatcatcaaccaccccgaggcggccatgctgggcgtcggccgcatcatccccaagccgtgggtgcacgagggcgagctggcggtgcggcaggtcgtccagctctcgctcaccttcgaccaccgggtgtgcgacggcggcacggcaggcggtttcctgcgctacgtggcggactgcgtggaacagccggcggtgctgctgcgcaccctgtag

SEQ ID NO: 47 - protein, 423 aa, Pseudomonas putida
  MISC_FEATURE: BKD E2 component
MGTHVIKMPDIGEGIAQVELVEWFVKVGDIIAEDQVVADVMTDKATVEIPSPVSGKVLALGGQPGEVMAVGSELIRIEVEGSGNHVDVPQPKPVEAPAAPIAAKPEPQKDVKPAVYQAPANHEAAPIVPRQPGDKPLASPAVRKRALDAGIELRYVHGSGPAGRILHEDLDAFMSKPQSNAGQAPDGYAKRTDSEQVPVIGLRRKIAQRMQDAKRRVAHFSYVEEIDVTALEALRQQLNSKHGDSRGKLTLLPFLVRALVVALRDFPQINATYDDEAQIITRHGAVHVGIATQGDNGLMVPVLRHAEAGSLWANAGEISRLANAARNNKASREELSGSTITLTSLGALGGIVSTPVVNTPEVAIVGVNRMVERPVVIDGQIVVRKMMNLSSSFDHRVVDGMDAALFIQAVRGLLEQPACLFVE

SEQ ID NO: 48 - DNA, 1272 bp, Pseudomonas putida
  misc_feature: Encodes BKD E2 component
tcactccacgaacaggcaggcgggttgttcgagcaggccacgcacggcctggatgaacagggcggcgtccatgccatcgaccacgcggtggtcgaacgagctggacaggttcatcatcttgcgcacgacgatctggccatcaatcaccaccggtcgttcgaccatgcggttgaccccgacgattgccacttccggggtgttgaccaccggcgtgctgacaatgccacccaaggcgccgaggctggtcagggtgatggtcgagccggacagctcctcgcggctggccttgttgttacgtgcagcgttggccaggcgcgaaatctcgccggcattggcccacaggctgcccgcttcggcgtggcgcagcacgggtaccatcaggccgttgtcaccctgggtggcaatgcccacatgcaccgcgccatggcgggtgatgatctgcgcttcgtcgtcgtaggtcgcgttgatctgcgggaagtcacgcagcgccacgacgagggcgcgcaccaggaatggcagcaaggtcagtttgccgcggctgtcgccgtgcttgctgttgagttgctggcgcagggcttccagggcggtgacgtcgatttcctcgacataactgaagtgcgcgacccggcgtttggcgtcctgcatgcgctgggcgatcttgcggcgcaggccgatcaccggcacctgctcgctgtcggtgcgcttggcataaccatcaggtgcttgcccggcattgctttgcggcttgctcatgaaggcgtcgaggtcttcgtgcagaatgcgcccggccgggccgctaccatgcacataacgcagttcgataccggcgtccagggcgcgtttgcgcacggccggcgaggccagcggcttgtcgcccggctggcgcggcacgatgggcgcagcttcgtggttggcgggcgcctggtacacggcgggttttacgtctttctgcggttccggcttggctgcaatcggggcggccggggcctctaccggttttggctgaggcacgtccacatggttgccgctgccttccacttcgatgcggatcagttcgctaccgaccgccatcacttccccgggctggccacccagggccaacaccttgccgctgaccggcgaggggatttccacggtggccttgtcggtcatgacgtcggccaccacctggtcctcggcgatgatgtcgccgaccttgacgaaccattccaccaactcgacctgcgcgatgccttcgccaatgtccggcatcttgatgacgtgcgtgcccat

SEQ ID NO: 49 - protein, 416 aa, Listeria monocytogenes
  MISC_FEATURE: BKD E2 component
MAVEKITMPKLGESVTEGTISSWLVKPGDTVEKYDAIAEVLTDKVTAEIPSSFSGTIKEILAEEDETLEVGEVICTIETEEASSSEPVVEAEQTEPKTPEKQETKQVKLAEAPASGRFSPAVLRIAGENNIDLSTVEGTGKGGRITRKDLLQVIENGPVAPKREEVKSAPQEKEATPNPVRSAAGDREIPINGVRKAIAKHMSVSKQEIPHAWMMVEVDATGLVRYRNTVKDSFKKEEGYSLTYFAFFIKAVAQALKEFPQLNSTWAGDKIIEHANINISIAIAAGDLLYVPVIKNADEKSIKGIAREISELAGKARNGKLSQADMEGGTFTVNSTGSFGSVQSMGIINHPQAAILQVESIVKRPVIIDDMIAVRDMVNLCLSIDHRILDGLLAGKFLQAIKANVEKISKENTALY

SEQ ID NO: 50 - DNA, 1251 bp, Listeria monocytogenes
  misc_feature: Encodes BKD E2 component
gtggcagttgaaaaaatcaccatgcccaaattaggggaaagtgtaacagaaggaacgattagttcatggttagttaaaccaggcgatacagtagaaaaatatgatgctatcgcggaagttttaacagataaagtaacagctgaaatcccatcatcctttagtggcactatcaaagaaattttagcagaggaagatgaaacactagaagtaggcgaagttatttgtaccatcgaaacagaagaggctagtagttcagagcctgtagttgaagcagaacaaacagaaccaaaaactccagaaaaacaagaaacaaaacaagtgaaattagcagaagcaccagccagtggaagattttcaccagcggtactgcgtattgctggagaaaacaatattgatttatcaaccgtagaaggcacaggtaaaggtggccgaattacaagaaaagatttacttcaagtaattgaaaatggtccagtagctccgaaacgcgaggaagtgaagtctgctccacaagaaaaagaagcgacgccaaatcctgtacgttcagcagcaggtgacagagaaatcccaatcaatggtgtaagaaaagcgattgctaaacatatgagcgtgagtaaacaagaaattccgcatgcttggatgatggtggaagtagatgcaactggtcttgttcgctatcgtaatacagttaaagacagctttaaaaaagaagaaggttattcattaacttatttcgcctttttcatcaaagccgttgcacaagcattgaaagaattcccgcaacttaacagcacgtgggcaggcgataaaattattgagcatgcgaatatcaatatttcgattgcgattgcagctggcgatttattgtatgtgccagttattaaaaatgcggacgaaaaatccattaaaggtattgctcgcgaaataagtgaactagctggaaaagcgcgtaatggtaaactgagccaagccgatatggaaggtgggactttcactgtaaatagtactggttcatttggctctgttcaatcaatggggattattaaccacccacaagccgctattcttcaagtggaatccattgttaagcgcccagtcattattgacgatatgattgctgtacgagatatggtcaacctatgtctatccatcgatcatcgtattttagacggcttactagcaggtaaattcttacaagcaattaaagccaatgtcgaaaagatttctaaagaaaatacagcgttgtattaa

SEQ ID NO: 51 - protein, 355 aa, Micrococcus luteus; identical to SEQ ID NO: 30
  MISC_FEATURE: BKD E2 component

SEQ ID NO: 52 - DNA, 1068 bp, Micrococcus luteus; identical to SEQ ID NO: 31
  misc_feature: Encodes BKD E2 component

SEQ ID NO: 53 - protein, 424 aa, Staphylococcus aureus
  MISC_FEATURE: BKD E2 component
MEITMPKLGESVHEGTIEQWLVSVGDHIDEYEPLCEVITDKVTAEVPSTISGTITEILVEAGQTVAIDTIICKIETADEKTNETTEEIQAKVDEHTQKSTKKASATVEQTFTAKQNQPRNNGRFSPVVFKLASEHDIDLSQVVGSGFEGRVTKKDIMSVIENGGTTAQSDKQVQTKSTSVDTSSNQSSEDNSENSTIPVNGVRKAIAQNMVNSVTEIPHAWMMIEVDATNLVNTRNHYKNSFKNKEGYNLTFFAFFVKAVADALKAYPLLNSSWQGNEIVLHKDINISIAVADENKLYVPVIKHADEKSIKGIAREINTLATKARNKQLTTEDMQGGTFTVNNTGTFGSVSSMGIINHPQAAILQVESIVKKPVVINDMIAIRSMVNLCISIDHRILDGLQTGKFMNHIKQRIEQYTLENTNIY

SEQ ID NO: 54 - DNA, 1275 bp, Staphylococcus aureus
  misc_feature: Encodes BKD E2 component
ctaatatatatttgtattttctaaagtatactgttcgatacgctgtttaatatgattcataaatttaccagtttgtaaaccatctaaaatgcgatgatctattgaaatacataaatttaccatacttcgaattgcaatcatatcattaattactactggctttttaacgattgattctacttgtaatatcgctgcttgagggtgatttataatccccattgatgatactgaaccaaatgtaccagtattattaactgtaaatgttccaccttgcatatcttcagttgtcaattgcttattacgcgcttttgttgctaaagtattaatttctctagctatacctttgattgacttttcgtctgcatgcttaatcacaggtacgtataatttattttcatcagcaacagcaattgaaatattaatgtctttatgtaagacaatttcatttccttgccagctactatttaataaaggatatgcttttaaagcatctgctacagcttttacaaagaaagcaaagaacgttagattatatccttctttatttttaaagctgtttttataatgatttctcgtattcacaagatttgtagcatctacttcaatcatcatccatgcatgtggaatctctgttacactattaaccatattttgcgcaattgctttacgcacaccatttactggtattgtgctgttttcactattgtcttcagatgattggttacttgatgtatctactgatgttgattttgtttgaacttgtttgtcagattgagctgtggtaccaccattttcaataactgacattatatccttcttagttacacgaccttcaaatccactacctacaacttgtgataaatcaatgtcatgctctgaagcgagtttaaatacaacaggtgaaaagcgaccattattacgaggttgattttgtttagcagtaaatgtctgttccactgttgcactagcttttttagtagatttctgagtatgctcatccacttttgcttgtatctcttcagttgtttcatttgtcttttcatcagcagtttcaattttacagataattgtatcaatagctactgtctgccccgcttcaactaaaatttctgtaattgttcctgatatcgtggaagggacttcagctgtcactttatctgtaataacttcacataatggttcatattcatcaatatgatcaccaacagaaactaaccattgttcaatggtaccttcatgaacactctcacctaacttaggcattgttatttccat

SEQ ID NO: 55 - protein, 455 aa, Streptococcus mutans
  MISC_FEATURE: BKD E2 component
MAVEIIMPKLGVDMQEGEIIEWKKQEGDEVKEGEILLEIMSDKTNMEIEAEDSGVLLKIVKGNGQVVPVTEVIGYIGQAGEVLEIADVPASTVPKENSAAPAEKTKAMSSPTVAAAPQGKIRATPAARKAARDLGVNLNQVSGTGAKGRVHKEDVESFKAAQPKATPLARKIAIDKGIDLASVSGTGFGGKIIKEDILNLFEAAQPVNDVSDPAKEAAALPEGVEVIKMSAMRKAVAKSMVNSYLTAPTFTLNYDIDMTEMIALRKKLIDPIMEKTGFKVSFTDLIGLAVVKTLMKPEHRYLNASLINDATEIELHQFVNLGIAVGLDEGLLVPVVHGADKMSLSDFVIASKDVIKKAQTGKLKATEMSGSTFSITNLGMFGTKTFNPIINQPNSAILGVGATIQTPTVVDGEIKIRPIMALCLTIDHRLVDGMNGAKFMVDLKKLMENPFTLLI

SEQ ID NO: 56 - DNA, 1368 bp, Streptococcus mutans
  misc_feature: Encodes BKD E2 component
atggcagtcgaaattattatgcctaaacttggtgttgatatgcaggaaggcgaaatcatcgagtggaaaaaacaagaaggtgatgaggtcaaagaaggggagatcctccttgagattatgtctgacaagaccaatatggaaatcgaagctgaggattcaggtgtcctgcttaagattgttaaaggaaatggtcaagttgttcctgtaactgaggtcattggttatattggtcaagcaggtgaagttcttgaaatagctgatgttcctgcaagtacagttcctaaagaaaatagtgcagcacctgctgaaaaaacaaaagcaatgtcttctccgacagttgcagcagcccctcaaggaaagattcgagcaacaccagcagctcgtaaggcggctcgtgatctgggagttaacctgaatcaggtttcagggacaggcgctaaaggccgtgttcacaaggaagatgttgaaagctttaaagcagctcagcctaaagcaacaccattagctaggaaaattgctatagataaaggtattgatctagccagtgtctcaggaacaggttttggcggcaaaattatcaaggaagatattttaaatctgtttgaggcagctcagcctgttaatgatgtgtcagatcctgctaaagaagcagctgccttaccagagggtgttgaagtcattaagatgtctgccatgcgtaaggcagtggctaaaagcatggtcaattcttacctgacagctccaacttttactctcaattatgacattgacatgactgagatgattgcgttgcgtaaaaagttaattgatcctatcatggaaaaaacaggttttaaagttagcttcacagatttgattggtctggcagtcgtaaaaaccttaatgaaaccagaacatcgttacctcaatgcttcactcattaatgacgcgactgagattgaacttcatcaatttgttaaccttggtatcgccgttggacttgatgaaggactgttagtacctgttgttcatggtgcagataagatgagcttgtcagattttgttatagcttcaaaggatgtcattaagaaagctcagaccggtaaattaaaagccactgaaatgtctggttcaaccttttccattacaaacttggggatgtttggcactaagactttcaaccccattatcaatcagccaaattcggctattttgggtgtaggagcaactatccaaacgccaactgttgtggatggtgaaattaagattcgtccaatcatggcactgtgcttgaccatcgatcaccgcttggttgatggcatgaacggcgctaagttcatggttgatcttaaaaaactgatggaaaatccatttacattattgatttga

SEQ ID NO: 57 - protein, 14 aa, Artificial sequence
  Synthetic polypeptide
  MISC_FEATURE: BKD E2 motif
  VARIANT (2)..(2): Xaa is any amino acid
  VARIANT (4)..(4): Xaa is Leu or Arg
  VARIANT (5)..(5): Xaa is any amino acid
  VARIANT (6)..(6): Xaa is Arg or Leu
  VARIANT (8)..(10): Xaa is any amino acid
  VARIANT (12)..(12): Xaa is any amino acid
  VARIANT (13)..(13): Xaa is Asp or Glu
PXVXXXAXXXGXXL

SEQ ID NO: 58 - protein, 8 aa, Artificial sequence
  Synthetic polypeptide
  MISC_FEATURE: BKD E2 motif
  VARIANT (1)..(1): Xaa is Gly or Pro
  VARIANT (2)..(2): Xaa is Ser or Thr
  VARIANT (4)..(4): Xaa is Ala or Pro
  VARIANT (5)..(5): Xaa is any amino acid
  VARIANT (7)..(7): Xaa is any amino acid
XXGXXGXI

SEQ ID NO: 59 - protein, 16 aa, Artificial sequence
  Synthetic polypeptide
  MISC_FEATURE: BKD E2 motif
  VARIANT (1)..(1): Xaa is Val or Ile
  VARIANT (3)..(3): Xaa is Leu or Val
  VARIANT (4)..(4): Xaa is any amino acid
  VARIANT (6)..(6): Xaa is Leu or Val
  VARIANT (8)..(8): Xaa is any amino acid
  VARIANT (9)..(9): Xaa is Ala or Lys
  VARIANT (11)..(12): Xaa is any amino acid
  VARIANT (13)..(13): Xaa is Leu or Met
  VARIANT (14)..(15): Xaa is any amino acid
  VARIANT (16)..(16): Xaa is Ala or Ser
XPXXGXRXXAXXXXXX

SEQ ID NO: 60 - protein, 13 aa, Artificial sequence
  Synthetic polypeptide
  MISC_FEATURE: BKD E2 motif
  VARIANT (2)..(2): Xaa is Gly or Ser
  VARIANT (4)..(4): Xaa is any amino acid
  VARIANT (6)..(7): Xaa is any amino acid
  VARIANT (8)..(8): Xaa is Asn or Ser
  VARIANT (9)..(9): Xaa is any amino acid
  VARIANT (11)..(11): Xaa is any amino acid
  VARIANT (12)..(12): Xaa is Phe or Leu
GXTXTXXXXGXXG

SEQ ID NO: 61 - protein, 19 aa, Artificial sequence
  Synthetic polypeptide
  MISC_FEATURE: BKD E2 motif
  VARIANT (2)..(2): Xaa is any amino acid
  VARIANT (5)..(5): Xaa is any amino acid
  VARIANT (7)..(7): Xaa is Ile or Met
  VARIANT (8)..(8): Xaa is Leu or Val
  VARIANT (9)..(9): Xaa is any amino acid
  VARIANT (11)..(12): Xaa is any amino acid
  VARIANT (13)..(13): Xaa is Ile or Met
  VARIANT (14)..(16): Xaa is any amino acid
  VARIANT (18)..(18): Xaa is any amino acid
NXPEXAXXXVXXXXXXPXV

SEQ ID NO: 62 - protein, 12 aa, Artificial sequence
  Synthetic polypeptide
  MISC_FEATURE: BKD E2 motif
  VARIANT (2)..(2): Xaa is any amino acid
  VARIANT (3)..(3): Xaa is Leu or Ser
  VARIANT (4)..(4): Xaa is Ser or Thr
  VARIANT (6)..(6): Xaa is Asp or Leu
  VARIANT (9)..(9): Xaa is Val or Leu
  VARIANT (10)..(10): Xaa is any amino acid
LXXXFXHRXXDG

SEQ ID NO: 63 - protein, 474 aa, Bacillus subtilis
  MISC_FEATURE: BKD E3 component
MATEYDVVILGGGTGGYVAAIRAAQLGLKTAVVEKEKLGGTCLHKGCIPSKALLRSAEVYRTAREADQFGVETAGVSLNFEKVQQRKQAVVDKLAAGVNHLMKKGKIDVYTGYGRILGPSIFSPLPGTISVERGNGEENDMLIPKQVIIATGSRPRMLPGLEVDGKSVLTSDEALQMEELPQSIIIVGGGVIGIEWASMLHDFGVKVTVIEYADRILPTEDLEISKEMESLLKKKGIQFITGAKVLPDTMTKTSDDISIQAEKDGETVTYSAEKMLVSIGRQANIEGIGLENTDIVTENGMISVNESCQTKESHIYAIGDVIGGLQLAHVASHEGIIAVEHFAGLNPHPLDPTLVPKCIYSSPEAASVGLTEDEAKANGHNVKIGKFPFMAIGKALVYGESDGFVKIVADRDTDDILGVHMIGPHVTDMISEAGLAKVLDATPWEVGQTIHPHPTLSEAIGEAALAADGKAIHF

SEQ ID NO: 64 - DNA, 1425 bp, Bacillus subtilis
  misc_feature: Encodes BKD E3 component
ttaaaaatgaatggctttgccatctgcggcaagcgcagcttctccaattgcttcagaaagcgttggatgcgggtgaatcgtttgcccgacctcccacggtgttgcgtccagcactttggcaagacccgcttcagaaatcatgtcggtgacatgcgggccaatcatatgaacgccgagaatatcatctgtatctcggtcagccacgattttgacaaaaccgtcgctttcaccgtatacaagcgcttttccaatcgccataaatgggaacttgccgattttgacattatgcccgttcgcctttgcttcgtcttcggttaagccgacactggcagcttcagggcttgagtaaatgcacttcggcacaagcgtcggatcaagcggatgcggattgagacctgcaaaatgctcaacagcaataattccctcatgtgaagcaacgtgagctaactgcaggccaccgattacgtctccgattgcataaatatgagattccttcgtttggcagctttcattgactgaaatcatgccattttcagtaacaatatcggtgttctctaggccgatgccttcgatatttgcctgtctgccgatggaaacaagcattttctcagcagaataggtaacggtttctccgtctttttccgcttgtatgctgatatcgtctgatgtttttgtcattgtgtcaggcagcacttttgcccctgttatgaactggatgccttttttcttaagaagactttccatttcttttgaaatctctagatcttcagtcggcaatatgcgatccgcgtattcaataaccgttaccttaacgccaaaatcatgaagcatagacgcccattcgataccgataacccctccgccgacaatgatgattgactgtggcagctcctccatttggagcgcctcatctgaagtcagtacagacttaccgtccacttcaagacccggaagcattctcggtcttgatcctgttgcaatgatcacttgtttcgggatcagcatgtcattttcttcgccatttccccgctcaacagaaattgttcccggcagcggagagaagattgacggtccaaggatacgtccatatccggtgtacacgtcaatttttccttttttcattaaatgatttacacccgctgcaagcttatcaacaacggcttgcttacgctgctgcactttttcaaagttgagggacacgccagccgtttccactccgaattgatcggcttcacgagctgtccggtatacctctgcgcttctaagcagcgctttactcgggatacagcctttatgcagacatgttcccccgagtttttccttttccacaacggctgtttttaagccgagctgagcggctctgatggccgcaacataaccgccggtaccgccgcccagaatgactacgtcatactcagttgccat

SEQ ID NO: 65 - protein, 462 aa, Streptomyces avermitilis
  MISC_FEATURE: BKD E3 component
MANDASTVFDLVILGGGSGGYAAALRGAQLGLDVALIEKDKVGGTCLHRGCIPTKALLHAGEIADQARESEQFGVKATFEGIDVPAVHKYKDGVISGLYKGLQGLIASRKVTYIEGEGRLSSPTSVDVNGQRVQGRHVLLATGSVPKSLPGLAIDGNRIISSDHALVLDRVPESAIVLGGGVIGVEFASAWKSFGADVTVIEGLKHLVPVEDENSSKLLERAFRKRGIKFNLGTFFSKAEYTQNGVKVTLADGKEFEAEVLLVAVGRGPVSQGLGYEEQGVAMDRGYVLVDEYMRTNVPTISAVGDLVPTLQLAHVGFAEGILVAERLAGLKTVPIDYDGVPRVTYCHPEVASVGITEAKAKEIYGADKVVALKYNLAGNGKSKILNTAGEIKLVQVKDGAVVGVHMVGDRMGEQVGEAQLIYNWEALPAEVAQLIHAHPTQNEAMGEAHLALAGKPLHSHD

SEQ ID NO: 66 - DNA, 1389 bp, Streptomyces avermitilis
  misc_feature: Encodes BKD E3 component
tcagtcgtgcgagtgcagcggcttgcccgcgagggccaggtgggcctcgcccatcgcttcgttctgcgtcgggtgggcgtggatgagctgggcgacctcggccggcagcgcctcccagttgtagatcagctgggcttcgccgacctgctcgcccatacggtcaccgaccatgtggacgccgaccacggcaccgtccttcacctggacgagcttgatctcgcccgcggtgttgaggatcttgctcttgccgttgcccgccaggttgtacttcagagcgacgaccttgtccgcgccgtagatctccttggccttggcctcggtgatgcccacggaggcgacctcggggtggcagtacgtcacccgcggcacgccgtcgtagtcgatcgggacggtcttcagaccggccagacgctccgccaccaggatgccctcggcgaagccgacgtgcgcgagctggagcgtcgggaccaggtcaccgacggcggagatggtcgggacgttcgtccgcatgtactcgtcgaccaggacgtagccgcggtccatggcgacgccctgctcctcgtagccgaggccctgcgagaccgggccgcggccgacggcgacgagcaggacctcggcctcgaactccttgccgtcggcgagggtgaccttgacaccgttctgggtgtactcggccttcgagaagaaggtgcccaggttgaacttgatgccgcgcttgcggaacgcgcgctcaagaagcttggaggagttctcgtcctcgaccgggacgaggtgcttgaggccctcgatcaccgtcacgtcggctccgaaggacttccacgcggaggcgaactcgacgccgatgacgccgccgccgagcacgatcgcggactccgggacgcggtccaggaccagcgcgtggtcggaggagatgatgcggttgccgtcgatcgccaggcccggcagcgacttcggcacggagccggtcgccaggagcacgtggcggccctggacgcgctggccgttcacgtcgacggaggtcggggaggacagacggccctcaccctcgatgtacgtcaccttgcgggaggcgatcagcccctgcagacccttgtacaggcccgagatgaccccgtccttgtacttgtggacggccggtacgtcgatgccctcgaaggtggccttgacgccgaactgctcgctctcgcgggcctggtcggcgatctcgcccgcgtgcagcagcgccttggtggggatgcacccacggtgcaggcaggtaccgccgaccttgtccttctcgatcagggcgacgtccaggcccagctgcgctccgcgcagggccgcggcgtaaccaccgctaccaccgccgaggatcactaggtcgaaaacggtgctggcgtcgttcgccac

SEQ ID NO: 67 - protein, 459 aa, Pseudomonas putida
  MISC_FEATURE: BKD E3 component
MQQIIQTTLLIIGGGPGGYVAAIRAGQLGIPTVLVEGQALGGTCLNIGCIPSKALIHVAEQFHQASRFTEPSPLGISVASPRLDIGQSVTWKDGIVDRLTTGVAALLKKHGVKVVHGWAKVLDGKQVEVDGQRIQCEHLLLATGSTSVELPMLPLGGPVISSTEALAPKALPQHLVVVGGGYIGLELGIAYRKLGAQVSVVEARERILPTYDSELTAPVAESLKKLGIALHLGHSVEGYENGCLLASDGKGGQLRLEADQVLVAVGRRPRTKGFNLECLDLKMNGTAIAIDERCHTSMHNVWAIGDVAGEPMLAHRAMAQGEMVAEIIAGKARRFEPAAIAAVCFTDPEVVVVGKTPEQASQQALDCIVAQFPFAANGRAMSLESKSGFVRVVARRDNHLIVGWQAVGVAVSELSTAFAQSLEMGACLEDVAGTIHAHPTLGEAVQEAALRALGHALHI

SEQ ID NO: 68 - DNA, 1380 bp, Pseudomonas putida
  misc_feature: Encodes BKD E3 component
tcagatatgcaaggcgtggcccaacgcgcgtagggcggcttcttgcaccgcttcacccaacgtggggtgggcatgaatggtgccggccacatcttccaggcacgcgcccatctccagcgattgggcaaacgcggtggacagctcggagaccgccacgccaaccgcctgccaacccacgatcaggtggttgtcacggcgcgccaccacccgcacgaaaccgcttttcgactccaggctcatggcccggccattggcggcaaacgggaactgcgcgacgatgcagtccagggcctgctggctggcttgttccggggtcttgccgaccaccaccacttccgggtcggtaaagcacacggcggcaatcgctgccggctcgaagcgtcgggccttgccggcgatgatttcggcgaccatctcgccttgggccatggcccggtgcgccagcatcggttcgccagcgacgtcgccaatggcccagacgttgtgcatgctggtatgacagcgctcgtcgatggcaatggcggtgccgttcatcttcaggtccaggcattccaggttgaagcccttggtgcgtggccggcggcccacggccaccagtacctgatcggcttcaagacgcagttgcccacccttgccgtcgctggccagcaggcagccattttcgtagccctcgacgctgtggcccaggtgcaacgcgatgcccagtttcttcagcgactcggccaccggggcggtcaattcgctgtcgtaggtcggcaggatgcgttcgcgcgcttccaccacactcacctgtgcacccagcttgcgataggcaatgcccagctccaggccgatatagccaccgccgaccaccaccaggtgttgcggcagggctttcggcgccagggcttcggtcgaggaaatcaccgggccacccagcggcagcatcggcagttcgacactggtggaaccggtcgccagcaacagatgctcgcactggatacgctggccatcgacctcgacctgcttgccgtccagtaccttggcccagccatgcaccactttcaccccgtgctttttcagcaaggcggcaacaccggtggtcagacggtcgacaatgccgtccttccaggtgacgctctggccgatgtccaggcgcggcgaagccacgctgatgcccagcggcgagggttcggtaaagcgcgaggcttggtgaaactgctcggccacgtggatcagcgccttggacgggatgcagccgatgttcaggcaggtgccgcccagtgcctggccttccaccagtacggtaggaatgcccagttgcccggcgcggatggctgctacatagccgccagggccgccgccgatgatcaacagggtagtctggataatctgttgcat

SEQ ID NO: 69 - protein, 467 aa, Listeria monocytogenes
  MISC_FEATURE: BKD E3 component
MVVGDFPEERDTIVIGAGPGGYVAAIRAAQLGQKVTIIEKEYYGGVCLNVGCIPSKALITIGHRFKEAGHSDNMGITADNVNLDFTKAQEWKGGVVNKLTSGVKGLLKKNKVEMLEGEAFFVDDHSLRVIHPDSAQTYTFNNVIIATGSRPIEIPGFKYGKRVLSSTGALALTEVPKKLVVIGGGYIGTELGGAFANLGTELTILEGGPEILPTYEKDMVSLVKRNLKSKNVEMVTKALAKSAEETENGVKVTYEANGETKTIEADYVLVTVGRRPNTDEIGLEQAGVKVTERGLVEVDKQGRSNVSNIFAIGDIVPGVPLAHKASYEAKIAAEAIAGEKSENDYTALPAVVFSDPELATVGLTEKEAKEKGFDVKAAKFPFGGNGRALSLDAPEGFVRLVTRKEDGLVIGAQVAGMNASDIISEIGLAIESGITAEDIALTIHAHPSLGELTMEAAELALGRPIHM

SEQ ID NO: 70 - DNA, 1404 bp, Listeria monocytogenes
  misc_feature: Encodes BKD E3 component
atggtagtaggcgattttccagaagaaagagacaccatagtcatcggtgcaggcccaggtgggtatgtagccgcaatccgagctgcacaactcggacaaaaagttaccattattgaaaaagaatattacggcggtgtgtgcttaaacgtgggatgtattccttccaaagcacttatcacaatcggtcaccgttttaaagaagctggacactctgataacatgggtattacagcggacaacgtgaacttagatttcacaaaagcacaagaatggaaaggcggcgtagttaacaagcttacatcaggtgttaaaggccttcttaagaaaaataaagtagaaatgttagaaggagaagcgttcttcgtggatgatcattccttacgtgtgattcaccctgattccgctcaaacttatacattcaataacgttatcattgcaacaggatctcgtccaatcgaaatcccaggtttcaaatatggtaaacgtgtattaagctcaactggtgcacttgcactaacagaagttccgaaaaaattagtcgtaattggcggcggatatatcggaacagaactaggtggagcattcgctaaccttggtacagaactaactatccttgagggtggtccagaaatcttaccaacatacgaaaaagacatggtttccctagttaaacgtaatctgaaaagcaaaaacgttgaaatggttactaaagcacttgcaaaatctgctgaagaaactgaaaacggcgttaaagtaacgtatgaagctaacggtgaaacaaaaactatcgaagctgattatgttttagtaacagtaggtcgtcgtccaaatacagacgaaatcggtttagaacaagctggcgttaaagtaacagaacgcggtttagtagaagttgataaacaaggtcgctcgaacgtttctaatattttcgcaattggtgacatcgttcctggtgttcctctagctcacaaagctagctatgaagcaaaaatcgctgctgaagcaattgctggcgaaaaatccgaaaacgattatacagcacttccagctgtcgttttcagtgatccagaacttgctacagttggtttaacagaaaaagaagcaaaagaaaaaggctttgatgtaaaagctgctaaattcccattcggcggtaacggtcgtgcgctttccttagatgcacctgaaggatttgttcgtctagttactcgtaaagaagatggcctagttatcggcgcacaagttgccggaatgaacgcttctgatattatttcagaaatcggcttagcaatcgaatcaggcattacagcagaagacatcgcgcttactatccacgctcacccatcactaggagagcttacaatggaagcagccgaacttgctttaggtcgcccaattcatatgtaa

SEQ ID NO: 71 - protein, 476 aa, Micrococcus luteus
  MISC_FEATURE: BKD E3 component
MTEENSTFIPSLTIIGGGPGGYEAAMVAAKLGARVTLVERQGVGGAAVLTDVVPSKTLIAAADSMRRVGASVDLGVDLGGAEVHADMGRVGHRILNLAHEQSSDIRAGLERVGVRVIDGVGRVVGPHEVSVRALDDADAGAEPEIITSDAILVAVGASPRELPTAVPDGERIFNWKQVYNLKELPEHLIVVGSGVTGAEFASAYNRLGAKVTLVSSRDRVLPGEDADAAELLEKVFEGNGLRVVSRSRAESVERTETGVRVHLSGEGAEDTPSIEGSHALVAVGGVPNTAGLGLDDVGVKLADSGHVLVDGVSRTSVPSIYAAGDCTGKLALASVAAMQGRIAVAHLLGDALKPLRPHLLASNIFTSPEIATVGVSQAQVDSGQYQADVLRLDFHTNPRAKMSGAEEGFVKIFARQGSGTVIGGVVVSPRASELIYALALAVTHKLHVDDLADTFTVYPSMSGSIAEAARRLHVRV

SEQ ID NO: 72 - DNA, 1431 bp, Micrococcus luteus
  misc_feature: Encodes BKD E3 component
gtgaccgaggaaaacagcaccttcatcccgtccctgaccatcatcggcggcggccccggcggctacgaggccgccatggtggccgcgaagctgggcgcccgcgtgaccctggtcgagcgccagggggtgggcggcgcggccgtcctcacggacgtggtcccctccaagacgctgatcgccgccgccgactcgatgcgccgcgtgggcgcctccgtggacctgggggtcgacctcggcggggccgaggtccacgcggacatgggccgggtcggccaccgcatcctgaacctggcccacgagcagtcctcggacatccgcgcgggcctcgagcgggtcggtgtccgggtgatcgacggcgtgggccgcgtcgtcggcccccacgaggtgtccgtccgcgccctcgacgacgccgacgccggcgccgagcccgagatcatcacctcggacgcgatcctcgtggccgtcggcgcgagtccccgggagctgcccaccgccgtcccggacggcgagcggatcttcaactggaagcaggtctacaacctcaaggagctgcccgagcacctgatcgtcgtgggctccggcgtcaccggcgccgagttcgcctcggcctacaaccgcctcggcgccaaggtcaccctcgtctcctcgcgcgaccgcgtgctccccggcgaggacgccgacgccgcagagctgctcgagaaggtcttcgagggcaacggcctcagggttgtctcccgctcccgggccgagtcggtcgagcggaccgagaccggcgtgcgcgtgcacctctccggcgagggggccgaagacaccccgtcgatcgagggctcccacgcgctggtggccgtcggcggcgtgccgaacacggcgggcctcggcctcgacgacgtgggcgtgaagctggccgactccggccacgtgctcgtggacggcgtctcccgcacgtccgtgccgagcatctacgcggcgggcgactgcacgggcaagctcgccctcgcctcggtggcggccatgcaggggcgcatcgccgtggcccacctgctcggcgacgccctcaagccgctgcgcccgcacctgctggcctcgaacatcttcacctcgccggagatcgccaccgtgggcgtctcgcaggcgcaggtggactccggccagtaccaggcggacgtgctgcgactggacttccacaccaacccccgcgccaagatgtccggcgcggaggaggggttcgtgaagatcttcgcgcgtcagggctccggcaccgtgatcggcggcgtggtggtctcgccgcgcgcctccgagctgatctacgcgctcgcgctcgcggtcacgcacaagttgcacgtggacgacctcgcggacaccttcaccgtgtacccgtccatgtccgggtcgatcgcggaggcggcgcgccgcctccatgtgcgggtgtga

SEQ ID NO: 73 - protein, 473 aa, Staphylococcus aureus
  MISC_FEATURE: BKD E3 component
MSEKQYDLVVLGGGTAGYVAAIRASQLGKKVAIVERQLLGGTCLHKGCIPTKSLLKSAEVFQTVKQAAMFGVDVKDANVNFENMLARKEDIINQMYQGVKHLMQHNHIDIYNGTGRILGTSIFSPQSGTISVEYEDGESDLLPNQFVLIATGSSPAELPFLSFDHDKILSSDDILSLKTLPSSIGIIGGGVIGMEFASLMIDLGVDVTVIEAGERILPTESKQASQLLKKSLSARGVKFYEGIKLSENDINVNEDGVTFEISSDIIKVDKVLLSIGRKPNTSDIGLNNTKIKLSTSGHILTNEFQQTEDKHIYAAGDCIGKLQLAHVGSKEGVVAVDHMFEGNPIPVNYNMMPKCIYSQPEIASIGLNIEQAKAEGMKVKSFKVPFKAIGKAVIDSHDANEGYSEMVIDQSTEEIVGINMIGQHVTELINEASLLQFMNGSALELGLTTHAHPSISEVLMELGLKAESRAIHV

SEQ ID NO: 74 - DNA, 1422 bp, Staphylococcus aureus
  misc_feature: Encodes BKD E3 component
ttatacgtgaatagctctactttctgctttcaatcctaattccatcaacacttcagagatggaaggatgtgcgtgtgttgttagtcctaattctaatgccgagccattcatgaactgtaacagtgatgcctcattaatcaattctgttacatgttgaccaatcatattaatacccacaatttcttcagttgattgatcaatcaccatttcgctatacccttcgtttgcgtcatggctatcaatcactgctttaccaattgctttaaatggtactttaaaacttttaactttcattccctctgcctttgcttgttcaatgtttaaaccgatagaagcaatttcaggttgtgaataaatacacttaggcatcatgttatagtttactgggattgggttcccctcaaacatatgatcaacagccacaacaccttcttttgatccaacatgtgccaattgtaattttcctatacaatcaccagctgcataaatatgtttatcttcagtttgttgaaattcgttcgttaaaatatgtcctgatgtagaaagttttattttagtgttgtttaaaccaatatctgatgtgttaggttttctaccaatcgatagcaacactttatctactttaattatgtctgaagaaatttcaaacgtaacaccatcttcgttaacatttatatcattttcagaaagttttattccctcatagaatttaacaccacgtgctgacaatgatttttttaatagttgtgaagcttgtttactttcagttggtaaaattctttcacctgcttctataactgttacgtcaacacctaaatctatcatcaatgatgcaaattccattccgataacaccaccaccaataataccaatacttgatggtaacgtctttaatgataatatatcatcgctagataaaattttatcatgatcaaatgataagaatggcaactctgcaggcgaagaaccagttgcaattaatacaaattggttgggtaataagtctgattcaccatcttcatattcgacagaaattgtgccactttgaggtgaaaatatagatgtacctagaatacgtcccgtgccattataaatgtcaatgtgattgtgttgcattaaatgctttacaccttgatacatttgattaataatgtcttcttttcgtgccaacatattttcaaaattaacattagcatctttgacatcaacgccaaacattgctgcctgttttactgtttgaaatacttcagcagatttaagcagcgatttagtaggaatacaacctttatggagacaagtacctcctaatagttgtcgttctactattgccactttcttacctaattgagacgcacgtatcgcagcaacatatcctgcagtacctccaccgagaacgactaaatcatattgtttctctgacat

SEQ ID NO: 75 - protein, 581 aa, Streptococcus mutans
  MISC_FEATURE: BKD E3 component
MAVEIIMPKLGVDMQEGEIIEWKKQEGDEVKEGDILLEIMSDKTNMEIEAEDSGVLLKIVKGNGQVVPVTEVIGYIGSAGETIETNAAPAASADDLKAAGLEVPDTLGESAAPAAQKTPLADDEYDMIVVGGGPAGYYAAIRGAQLGGKVAIVEKSEFGGTCLNKGCIPTKTYLKNAEILDGIKIAAGRGINFASTNYTIDMDKTVAFKDTVVKTLTSGVQGLLKANKVTIFNGLGQVNPDKTVTVGSETIKGHNIILATGSKVSRINIPGIDSPLVLTSDDILDLREIPKSLAVMGGGVVGIELGLVYASYGTEVTVIEMADRIIPAMDKEVSLELQKILSKKGMNIKTSVGVAEIVEANNQLTLKLNDGSEVVAEKALLSIGRVPQLSGLENLNLELERGRIKVDDYQETSISGIYAPGDVNGRKMLAHAAYRMGEVAAENAIWGNVRKANLKYTPAAVYTHPEVAMCGITEEQARQEYGNVLVGKSSFSGNGRAIASNEAQGFVKVVADAKYHEILGVHIIGPAAAEMINEASTIMENELTVDELLRSIHGHPTFSEVMYEAFADVLGEAIHNPPKRR

SEQ ID NO: 76 - DNA, 1746 bp, Streptococcus mutans
  misc_feature: Encodes BKD E3 component
atggcagtcgaaattattatgcctaaactcggtgttgatatgcaggaaggcgaaatcatcgagtggaaaaaacaagaaggtgatgaggtcaaagaaggggatatcctccttgaaatcatgtctgacaagaccaatatggaaattgaagctgaggattcaggtgtcctgctcaaaattgttaaaggaaatggtcaagttgtccctgtgactgaggtcattggttatattggttctgctggtgaaacgattgaaacaaatgcagcgccagcagcttcagctgatgatctcaaagcagcgggtcttgaagttcctgatactttaggcgagtcagcagcaccagcagctcaaaaaactccgcttgctgatgatgagtatgatatgattgtcgttggtggtggtcctgctggttattatgctgctattcgcggtgcacaattgggcggcaaggttgctatcgtcgaaaaatcagaatttggagggacttgtttaaataaaggctgcattccaactaaaacttatcttaagaatgctgaaatccttgatggcatcaaaattgcagcgggtcgcggtattaattttgcttcaaccaactataccattgacatggacaaaacggttgcctttaaagataccgttgttaaaacattgacaagtggggttcagggtcttcttaaagccaataaagtgactattttcaatggtctcggtcaggttaatcctgataagacagtgactgtcggttcggaaacgattaaaggacataatattatccttgcaacaggttcaaaagtgtctcgtattaatattccgggaattgattcacctcttgttttaacatcggatgatattcttgatcttcgtgaaattccaaagtcacttgctgttatgggcggtggtgttgtcggcattgaactcggtcttgtttacgcttcctatggtacagaagtgactgttattgaaatggctgatcgcattattcctgctatggacaaggaagtatcgcttgaactgcaaaaaattctatccaagaaaggaatgaacattaagacttctgttggtgtggctgaaattgttgaagctaacaatcaattaacgctgaaactcaatgacggctctgaagttgtggctgaaaaggccctgctttctattggtcgtgtcccacaattaagcggtttagaaaatcttaatctggaacttgaacgcggtcgcatcaaagtggacgattatcaggaaacctctatttcaggtatttatgccccgggtgatgttaatggaagaaagatgttagcgcatgctgcctatcgtatgggtgaagtagctgccgaaaatgctatctggggaaatgttcgtaaggctaacctgaaatatacaccagcagctgtttacacccatccagaggttgctatgtgcggtattactgaagaacaagcccgtcaagaatatggaaacgtcttagttgggaaatcctctttttcaggaaatggacgtgcgatcgcttctaatgaagcacaaggatttgtcaaagttgtcgcagatgctaaataccatgaaattcttggagtccatattattggaccagcagctgctgagatgattaatgaagcctcaacgattatggaaaatgagttgacggttgatgagctgctacgttctattcatggccatcctaccttctcggaggttatgtatgaagcctttgcagacgtccttggcgaagctatccataacccgccaaagcgtcgttaa

SEQ ID NO: 77 - protein, 474 aa, Escherichia coli [sequence omitted]

SEQ ID NO: 78 - DNA, 1425 bp, Escherichia coli
  misc_feature: Encodes E3 component
atgagtactgaaatcaaaactcaggtcgtggtacttggggcaggccccgcaggttactccgctgccttccgttgcgctgatttaggtctggaaaccgtaatcgtagaacgttacaacacccttggcggtgtttgcctgaacgtcggctgtatcccttctaaagcactgctgcacgtagcaaaagttatcgaagaagccaaagcgctggctgaacacggtatcgtcttcggcgaaccgaaaaccgatatcgacaagattcgtacctggaaagagaaagtgatcaatcagctgaccggtggtctggctggtatggcgaaaggccgcaaagtcaaagtggtcaacggtctgggtaaattcaccggggctaacaccctggaagttgaaggtgagaacggcaaaaccgtgatcaacttcgacaacgcgatcattgcagcgggttctcgcccgatccaactgccgtttattccgcatgaagatccgcgtatctgggactccactgacgcgctggaactgaaagaagtaccagaacgcctgctggtaatgggtggcggtatcatcggtctggaaatgggcaccgtttaccacgcgctgggttcacagattgacgtggttgaaatgttcgaccaggttatcccggcagctgacaaagacatcgttaaagtcttcaccaagcgtatcagcaagaaattcaacctgatgctggaaaccaaagttaccgccgttgaagcgaaagaagacggcatttatgtgacgatggaaggcaaaaaagcacccgctgaaccgcagcgttacgacgccgtgctggtagcgattggtcgtgtgccgaacggtaaaaacctcgacgcaggcaaagcaggcgtggaagttgacgaccgtggtttcatccgcgttgacaaacagctgcgtaccaacgtaccgcacatctttgctatcggcgatatcgtcggtcaaccgatgctggcacacaaaggtgttcacgaaggtcacgttgccgctgaagttatcgccggtaagaaacactacttcgatccgaaagttatcccgtccatcgcctataccgaaccagaagttgcatgggtgggtctgactgagaaagaagcgaaagagaaaggcatcagctatgaaaccgccaccttcccgtgggctgcttctggtcgtgctatcgcttccgactgcgcagacggtatgaccaagctgattttcgacaaagaatctcaccgtgtgatcggtggtgcgattgtcggtactaacggcggcgagctgctgggtgaaatcggcctggcaatcgaaatgggttgtgatgctgaagacatcgcactgaccatccacgcgcacccgactctgcacgagtctgtgggcctggcggcagaagtgttcgaaggtagcattaccgacctgccgaacccgaaagcgaagaagaagtaa

SEQ ID NO: 79 - protein, 17 aa, Artificial sequence
  Synthetic polypeptide
  MISC_FEATURE: BKD E3 motif
  VARIANT (1)..(1): Xaa is Ile or Val
  VARIANT (4)..(4): Xaa is Ala or Thr
  VARIANT (5)..(5): Xaa is Ser or Cys
  VARIANT (6)..(6): Xaa is Val or Leu
  VARIANT (7)..(8): Xaa is any amino acid
  VARIANT (9)..(9): Xaa is Gly or Asp
  VARIANT (11)..(11): Xaa is Val or Ile
  VARIANT (13)..(13): Xaa is Thr or Ser
  VARIANT (15)..(15): Xaa is Ala or Thr
  VARIANT (16)..(16): Xaa is Met or Leu
  VARIANT (17)..(17): Xaa is Ile or Leu
XGGXXXXXXCXPXKXXX

SEQ ID NO: 80 - protein, 17 aa, Artificial sequence
  Synthetic polypeptide
  MISC_FEATURE: BKD E3 motif
  VARIANT (1)..(1): Xaa is Leu or Ile
  VARIANT (5)..(5): Xaa is Gly or Ser
  VARIANT (6)..(6): Xaa is any amino acid
  VARIANT (7)..(7): Xaa is Ser or Pro
  VARIANT (8)..(9): Xaa is any amino acid
  VARIANT (11)..(11): Xaa is Ala or Pro
  VARIANT (12)..(12): Xaa is Asp or Gly
  VARIANT (13)..(15): Xaa is any amino acid
  VARIANT (16)..(16): Xaa is Asp or Leu
XATGXXXXXLXXXXXXG

SEQ ID NO: 81 - protein, 12 aa, Artificial sequence
  Synthetic polypeptide
  MISC_FEATURE: BKD E3 motif
  VARIANT (1)..(1): Xaa is Val or Ile
  VARIANT (2)..(2): Xaa is any amino acid
  VARIANT (4)..(4): Xaa is Gly or Ser
  VARIANT (6)..(6): Xaa is any amino acid
  VARIANT (7)..(7): Xaa is Ile or Thr
  VARIANT (9)..(9): Xaa is any amino acid
  VARIANT (11)..(11): Xaa is any amino acid
  VARIANT (12)..(12): Xaa is Ala or Gly
XXGXGXXGXEXX

SEQ ID NO: 82 - protein, 14 aa, Artificial sequence
  Synthetic polypeptide
  MISC_FEATURE: BKD E3 motif
  VARIANT (2)..(7): Xaa is any amino acid
  VARIANT (8)..(8): Xaa is Ala or Val
  VARIANT (9)..(9): Xaa is any amino acid
  VARIANT (12)..(13): Xaa is any amino acid
  VARIANT (14)..(14): Xaa is Pro or Gly
TXXXXXXXXGDXXX

SEQ ID NO: 83 - protein, 11 aa, Artificial sequence
  Synthetic polypeptide
  MISC_FEATURE: BKD E3 motif
  VARIANT (1)..(1): Xaa is Ile or Val
  VARIANT (2)..(2): Xaa is Gly or Ala
  VARIANT (3)..(4): Xaa is any amino acid
  VARIANT (5)..(5): Xaa is Phe or Ile
  VARIANT (6)..(6): Xaa is Thr or His
  VARIANT (7)..(7): Xaa is any amino acid
  VARIANT (8)..(8): Xaa is Tyr or His
  VARIANT (10)..(10): Xaa is Ser or Thr
  VARIANT (11)..(11): Xaa is Gln or Leu
XXXXXXXXPXX

SEQ ID NO: 84 - protein, 312 aa, Bacillus subtilis
  MISC_FEATURE: beta ketoacyl-ACP synthase III (FabH1)
MKAGILGVGRYIPEKVLTNHDLEKMVETSDEWIRTRTGIEERRIAADDVFSSHMAVAAAKNALEQAEVAAEDLDMILVATVTPDQSFPTVSCMIQEQLGAKKACAMDISAACAGFMYGVVTGKQFIESGTYKHVLVVGVEKLSSITDWEDRNTAVLFGDGAGAAVVGPVSDDRGILSFELGADGTGGQHLYLNEKRHTIMNGREVFKFAVRQMGESCVNVIEKAGLSKEDVDFLIPHQANIRIMEAARERLELPVEKMSKTVHKYGNTSAASIPISLVEELEAGKIKDGDVVVMVGFGGGLTWGAIAIRWGR

SEQ ID NO: 85 - DNA, 939 bp, Bacillus subtilis
  misc_feature: Encodes beta ketoacyl-ACP synthase III (FabH1)
atgaaagctggaatacttggtgttggacgttacattcctgagaaggttttaacaaatcatgatcttgaaaaaatggttgaaacttctgacgagtggattcgtacaagaacaggaatagaagaaagaagaatcgcagcagatgatgtgttttcatcacatatggctgttgcagcagcgaaaaatgcgctggaacaagctgaagtggctgctgaggatctggatatgatcttggttgcaactgttacacctgatcagtcattccctacggtctcttgtatgattcaagaacaactcggcgcgaagaaagcgtgtgctatggatatcagcgcggcttgtgcgggcttcatgtacggggttgtaaccggtaaacaatttattgaatccggaacctacaagcatgttctagttgttggtgtagagaagctctcaagcattaccgactgggaagaccgcaatacagccgttctgtttggagacggagcaggcgctgcggtagtcgggccagtcagtgatgacagaggaatcctttcatttgaactaggagccgacggcacaggcggtcagcacttgtatctgaatgaaaaacgacatacaatcatgaatggacgagaagttttcaaatttgcagtccgccaaatgggagaatcatgcgtaaatgtcattgaaaaagccggactttcaaaagaggatgtcgactttttgattccgcatcaggcgaacatccgtatcatggaagctgctcgcgagcgtttagagcttcctgtcgaaaagatgtctaaaactgttcataaatatggaaatacttctgccgcatccattccgatctctcttgtagaagaattggaagccggtaaaatcaaagacggcgatgtggtcgttatggtagggttcggcggaggactaacatggggcgccattgcaatccgctggggccgataa

SEQ ID NO: 86 - protein, 325 aa, Bacillus subtilis
  MISC_FEATURE: beta ketoacyl-ACP synthase III  (FabH2)
MSKAKITAIGTYAPSRRLTNADLEKIVDTSDEWIVQRTGMRERRIADEHQFTSDLCIEAVKNLKSRYKGTLDDVDMILVATTTSDYAFPSTACRVQEYFGWESTGALDINATCAGLTYGLHLANGLITSGLHQKILVIAGETLSKVTDYTDRTTCVLFGDAAGALLVERDEETPGFLASVQGTSGNGGDILYRAGLRNEINGVQLVGSGKMVQNGREVYKWAARTVPGEFERLLHKAGLSSDDLDWFVPHSANLRMIESICEKTPFPIEKTLTSVEHYGNTSSVSIVLALDLAVKAGKLKKDQIVLLFGFGGGLTYTGLLIKWGM

SEQ ID NO: 87 - DNA, 978 bp, Bacillus subtilis
  misc_feature: Encodes beta ketoacyl-ACP synthase III
ttacatcccccatttaataagcaatcctgtataggttaatccgccgccaaacccgaaaagcaaaacgatttgatcttttttcagcttcccggctttcactgcgagatcgagcgccaaaacaattgaaaccgaagacgtgtttccgtagtgctcaacactagtgagcgttttttcaatcgggaacggtgttttttcacaaattgactcgatcatgcgcaagttggcgctgtgaggaacaaaccaatcgagatcatcggagctgagtcctgctttatgtaaaagccgttcaaattcgccagggacggttcttgcggcccatttatatacctcgcgtccgttttgcaccatttttccggaaccgacaagctgcacaccgtttatttcatttcgcagtccggcacgatacaaaatatcgccgccgttcccgcttgttccttgtacagacgcaagaaatcccggcgtctcttcatctcgttctactaacagcgcacccgcggcatcgccgaacagtacgcatgtcgttcgatcggtataatcggttacctttgataacgtctctccggcgatgacgagaattttttgatgaaggccagatgtgatcaatccatttgccaaatggaggccgtatgtcagcccggcgcatgtcgcattaatatccagcgcgccggtgctttcccagccgaaatattcctgtacgcggcatgccgtactcggaaaggcgtaatcggatgtggttgtggcaacgaggatcatatcgacatcatcaagcgttcctttataacggctcttgagattcttcaccgcttctatgcataaatcagaggtaaattgatgttcatccgcaatccggcgttctctcattcctgtgcgctgaacgatccattcatcagaggtatcaacgatcttttctaaatctgcattggttaaacgtctgctcggcgcataggtgccgatagctgtaatttttgcttttgacat

SEQ ID NO: 88 - protein, 313 aa, Staphylococcus aureus
  MISC_FEATURE: beta ketoacyl-ACP synthase III
MNVGIKGFGAYAPEKIIDNAYFEQFLDTSDEWISKMTGIKERHWADDDQDTSDLAYEASLKAIADAGIQPEDIDMIIVATATGDMPFPTVANMLQERLGTGKVASMDQLAACSGFMYSMITAKQYVQSGDYHNILVVGADKLSKITDLTDRSTAVLFGDGAGAVIIGEVSDGRGIISYEMGSDGTGGKHLYLDKDTGKLKMNGREVFKFAVRIMGDASTRVVEKANLTSDDIDLFIPHQANIRIMESARERLGISKDKMSVSVNKYGNTSAASIPLSIDQELKNGKIKDDDTIVLVGFGGGLTWGAMTIKWGK

SEQ ID NO: 89 - DNA, 942 bp, Staphylococcus aureus
  misc_feature: Encodes beta ketoacyl-ACP synthase III
atgaacgtgggtattaaaggttttggtgcatatgcgccagaaaagattattgacaatgcctattttgagcaatttttagatacatctgatgaatggatttctaagatgactggaattaaagaaagacattgggcagatgatgatcaagatacttcagatttagcatatgaagcaagtttaaaagcaatcgctgacgctggtattcagcccgaagatatagatatgataattgttgccacagcaactggagatatgccatttccaactgtcgcaaatatgttgcaagaacgtttagggacgggcaaagttgcctctatggatcaacttgcagcatgttctggatttatgtattcaatgattacagctaaacaatatgttcaatctggagattatcataacattttagttgtcggtgcagataaattatctaaaataacagatttaactgaccgttctactgcagttctatttggagatggtgcaggtgcggttatcatcggtgaagtttcagatggcagaggtattataagttatgaaatgggttctgatggcacaggtggtaaacatttatatttagataaagatactggtaaactgaaaatgaatggtcgagaagtatttaaatttgctgttagaattatgggtgatgcatcaacacgtgtagttgaaaaagcgaatttaacatcagatgatatagatttatttattcctcatcaagctaatattagaattatggaatcagctagagaacgcttaggtatttcaaaagacaaaatgagtgtttctgtaaataaatatggaaatacttcagctgcgtcaatacctttaagtatcgatcaagaattaaaaaatggtaaaatcaaagatgatgatacaattgttcttgtcggattcggtggcggcctaacttggggcgcaatgacaataaaatggggaaaatag

SEQ ID NO: 90 - protein, 335 aa, Streptomyces avermitilis
  MISC_FEATURE: beta ketoacyl-ACP synthase III
MSGGRAAVITGIGGYVPPDLVTNDDLAQRLDTSDAWIRSRTGIAERHVIAPGTATSDLAVEAGLRALKSAGDEHVDAVVLATTTPDQPCPATAPQVAARLGLGQVPAFDVAAVCSGFLFGLATASGLIAAGVADKVLLVAADAFTTIINPEDRTTAVIFADGAGAVVLRAGAADEPGAVGPLVLGSDGELSHLIEVPAGGSRQRSSGPTTDPDDQYFRMLGRDTYRHAVERMTDASQRAAELADWRIDDVDRFAAHQANARILDSVAERLGVPAERQLTNIARVGNTGAASIPLLLSQAAAAGRLGAGHRVLLTAFGGGLSWGAGTLVWPEVQPV

SEQ ID NO: 91 - DNA, 1008 bp, Streptomyces avermitilis
  misc_feature: Encodes beta ketoacyl-ACP synthase III
atgagcggcggacgcgcggcggtgatcaccgggatcgggggctatgtgcctcccgatctggtgaccaacgacgatctggcccagcggctcgacacctccgacgcgtggatccgctcgcgcaccgggatcgccgagcggcatgtgatcgcgcccggcaccgcgacctccgacctggcggtggaggccggactgcgggccctgaagtcggcgggcgacgagcacgtggacgcggtcgtcctggccaccacgacgcccgaccagccctgcccggcgaccgccccgcaggtggccgcacggctgggactcgggcaggtgccggcgttcgacgtggccgccgtctgctccggcttcctgttcggcctcgccaccgcgtccgggctgatcgcggccggggtggcggacaaggtcctgctggtcgccgccgacgcgttcaccacgatcatcaaccccgaggaccgcaccacggccgtcatcttcgcggacggcgcgggcgcggtggtgctgcgcgcgggcgccgccgacgagccgggggccgtcggcccgctggtgctcggcagcgacggcgagctgagccatctcatcgaggtgccggcgggcggctcgcgccagcgctcgtccggccccacgaccgacccggacgaccagtacttccggatgctcggccgggacacctaccggcacgcggtggagcggatgaccgatgcgtcccagcgggcggccgaactggccgactggcggatcgacgacgtcgaccggttcgcggcgcaccaggccaacgcccgcatcctcgactcggtcgcggaacgtctcggggtccccgccgaacggcagttgaccaacatcgcccgggtcggcaacaccggcgccgcctcgatcccgctgcttctgtcgcaggcggccgcggccggccggctcggcgccgggcaccgggtgctcctgaccgcgttcggcgggggcctgtcctggggcgcggggactctggtctggccggaggtccagccggtctga

SEQ ID NO: 92 - protein, 325 aa, Streptococcus mutans
  MISC_FEATURE: beta ketoacyl-ACP synthase III
MTFAKISQAAYYVPSQVVTNDDLSKIMDTSDEWITSRTGIRERRISQSEDTSDLASQVAKELLKKASLKAKEIDFIIVATITPDAMMPSTAACVQAKIGAVNAFAFDLTAACSGFIFALSAAEKMIKSGQYQKGLVIGAEVLSKIIDWSDRTTAVLFGDGAGGVLLEADSSEHFLFESIHSDGSRGESLTSGEHAVSSPFSQVDKKDNCFLKMDGRAIFDFAIRDVSKSISMLIRKSDMPVEAIDYFLLHQANIRILDKMAKKIGADREKFPANMMKYGNTSAASIPILLAECVENGTIELNGSHTVLLSGFGGGLTWGSLIVKI

SEQ ID NO: 93 - DNA, 978 bp, Streptococcus mutans
  misc_feature: Encodes beta ketoacyl-ACP synthase III
ctaaattttaacaattaaactgccccatgtcaaacccccaccgaacccgctcaggagaacagtgtgtgaaccatttagctctatagttccattttcgacacattcggctaataaaataggaatacttgctgcactggtattaccatacttcatcatattagcaggaaatttttctctatcagcgccaatttttttagccattttatccaaaatacgaatattagcctgatgtaataagaaataatcaatcgcttctacaggcatatctgacttcctaatgagcatcgaaatactttttgacacatcacgaatagcaaagtcaaatatagctcgaccatccatttttagaaaacagttatcttttttatcaacctgtgaaaagggtgacgaaacagcgtgttcacctgatgtcaaactttcaccacgactgccatctgaatgaatagattcaaataaaaaatgttcagaagaatctgcttctaaaagaacaccgccagctccatctccaaaaagaacagctgttgttcgatccgaccaatcgatgattttagatagaacttctgcaccgataactaaacctttctggtactgaccggatttaatcattttttccgcagctgaaagtgcaaaaataaatccactgcaggcggcagttaaatcgaaagcaaaagcattcactgcaccaattttcgcttggacacaagcagctgttgatggcatcattgcatccggagtaattgtagcaacaataataaaatcaatctctttcgcctttaatgaggctttttttaaaagttctttggccacctgactggctaagtcactggtatcttcggattgactaatacggcgctctcttattcccgtacgacttgtaatccattcatcactggtatccattattttagataaatcatcattggtgacaacctgtgatggtacataatatgctgcttgactaatctttgcaaaagtcat

SEQ ID NO: 94 - protein, 325 aa, Lactococcus lactis
  MISC_FEATURE: beta ketoacyl-ACP synthase III
MTFAKITQVAHYVPENVVSNDDLSKIMDTNDEWIYSRTGIKNRHISTGENTSDLAAKVAKQLISDSNLSPETIDFIIVATVTPDSLMPSTAARVQAQVGAVNAFAYDLTAACSGFVFALSTAEKLISSGAYQRGLVIGAEVFSKVIDWSDRSTAVLFGDGAAGVLIEAGASQPLIIAEKMQTDGSRGNSLLSSYADIQTPFASVSYESSNLSMEGRAIFDFAVRDVPKNIQATLEKANLSAEEVDYYLLHQANSRILDKMAKKLGVTRQKFLQNMQEYGNTSAASIPILLSESVKNGIFSLDGQTKVVLTGFGGGLTWGTAIINL

SEQ ID NO: 95 - DNA, 978 bp, Lactococcus lactis
  misc_feature: Encodes beta ketoacyl-ACP synthase III
atgacttttgcgaaaattacgcaagtggcacactatgtgcctgaaaatgtggtatctaatgatgacttgtccaaaataatggatactaatgatgaatggatttacagtcggacagggattaaaaatcgccatatttcaactggagagaacacctcagacttagcagctaaagttgctaagcagttgattagcgattcaaatttaagcccagaaacgattgacttcatcattgttgctacagtaactccggactcattgatgccttcaaccgcggcacgggttcaagctcaagtaggagcagttaatgcttttgcttacgatttgactgcggcttgttcaggctttgtctttgctctatcaacagcggaaaaattaatttcctcaggagcatatcaacgagggcttgtcattggcgcagaagtcttttcaaaagtaattgattggtcagaccgatcaactgctgttcttttcggagatggagctgctggtgtgcttattgaagctggcgcgagtcaacctctgattattgctgaaaaaatgcaaacagatggaagtcgtgggaacagtttactttctagttatgctgacatccaaactccatttgcctctgtttcatacgaaagttcaaacttgagtatggaagggcgagcaatttttgattttgccgtacgtgatgttcctaaaaatatccaggcaactttagaaaaagctaatttgtctgctgaagaagtagattattatctccttcatcaagcgaattcaagaatccttgataaaatggctaaaaagcttggtgtgacgcgccaaaagttccttcaaaatatgcaagaatatggtaacacatcggcagcaagtatccctatattgttgtcagaatccgtaaaaaatggtatatttagtttggacggtcaaacaaaagtcgtcttgacaggatttggcggtggcctcacttggggtacagcaattattaatttataa

SEQ ID NO: 96 - protein, 320 aa, Streptomyces coelicolor
  MISC_FEATURE: beta ketoacyl-ACP synthase III
MARGAGRLTGIGVYRPGGLLTSAELDTRFGHEDGYIEQITGIRTRLKADPDDTFVEMAAQAADKALAHAGVLAEDLDCVLFSSASSVGQASCRAASLTHRIGAGRAGGFDLNGGCAGFGYGLTLASGLIAAQQARQILVVAAERLSDITDPDDCGTVMVFGDAAGAAVVSAAEHPGIGPAVWGTHGPGEPWMTSAPPKPGAARPYMHMDGTRVVRWFGSQMPQVARDALEAAGLTWDDIGAFVPHQCNGRLIDAMVRRLRPPEHVAIARSIVTDGNTSSASIPLALESLLASATVRPGDKALLLGFGAGLTWCAQVVELP

SEQ ID NO: 97 - DNA, 963 bp, Streptomyces coelicolor
  misc_feature: Encodes beta ketoacyl-ACP synthase III
ttacggaagttcgaccacctgggcgcaccaggtcagcccggcgccgaagcccaggagcagcgccttgtcgccgggccgtacggtggccgaggcgagcagcgactccagggccagcgggatggacgccgaactggtgttgccgtcggtgacgatgctgcgggcgatcgccacgtgctcgggcgggcgcagtcggcgcaccatcgcgtcgatcagccggccgttgcactggtgcggcacgaaggcgccgatgtcgtcccaggtgagcccggccgcctcgagtgcgtcccgggccacttgcggcatctgcgaaccgaaccagcggaccacccgggtgccgtccatgtgcatgtacgggcgggcggcaccgggtttgggcggggcgctggtcatccagggctcaccggggccgtgggttccccacaccgccggtccgatcccggggtgctcggctgcgctgaccaccgcggccccggcggcatcgccgaagaccatgacggtcccgcagtcgtcggggtcggtgatgtcgctcagccgctcggcggcgacgaccaggatctgacgcgcctgctgtgcggcgatgagtccggacgccagggtcagcccgtaaccgaacccggcgcacccgccgttgaggtcgaacccgccggcccggccggcgccgatgcggtgggtgagactggcggcccggcacgacgcctggccgacgctgctggcggaggagaacaggacgcagtccaggtcctcggcgagcacgcccgcgtgggccagggccttgtccgccgcctgcgcggccatctcgacgaaggtgtcgtcggggtcggccttcagcctggtccggattccggtgatctgctcgatatagccgtcctcgtgaccgaacctggtgtcgagttcggcgctggtgagcaggccaccggggcggtagacgccgatgccggtcagccgccccgcgccccgggccat

SEQ ID NO: 98 - protein, 312 aa, Listeria monocytogenes
  MISC_FEATURE: beta ketoacyl-ACP synthase III
MNAGILGVGKYVPEKIVTNFDLEKIMDTSDEWIRTRTGIEERRIARDDEYTHDLAYEAAKVAIENAGLTPDDIDLFIVATVTQEATFPSVANIIQDRLGATNAAGMDVEAACAGFTFGVVTAAQFIKTGAYKNIVVVGADKLSKITNWDDRATAVLFGDGAGAVVMGPVSDDHGLLSFDLGSDGSGGKYLNLDENKKIYMNGREVFRFAVRQMGEASLRVLERAGLEKEELDLLIPHQANIRIMEASRERLNLPEEKLMKTVHKYGNTSSSSIALALVDAVEEGRIKDNDNVLLVGFGGGLTWGALIIRWGK

SEQ ID NO: 99 - DNA, 939 bp, Listeria monocytogenes
  misc_feature: Encodes beta ketoacyl-ACP synthase III
atgaacgcaggaattttaggagtaggtaaatacgtacctgaaaaaatagtaacaaattttgatttagaaaaaataatggatacatccgatgagtggattcgtactcgaactggtattgaagaaagaagaattgctcgtgatgacgaatatacgcacgacttagcatacgaagcagcaaaggtagctattgagaatgctgggcttacaccagatgacattgacttatttattgttgccactgtgacgcaggaagcgacttttccatccgttgcgaatattattcaagaccgtttaggagcaacaaatgctgcgggtatggacgtggaagcggcatgtgccggttttacttttggcgtagtaactgcagcacaatttattaaaacaggggcatacaagaatatcgtcgtagttggtgcggataaattatctaaaatcactaactgggatgatcgcgcaacagccgtattatttggtgatggagcgggagccgttgttatgggtccggtttctgatgaccatggactactttcgtttgacttaggctcagatggatctggcggcaaatacttgaacttagatgaaaataagaagatttatatgaatggacgtgaagtgttccgttttgcagttcgccaaatgggagaagcttcgttacgagtacttgaacgtgctggacttgaaaaagaagaattggatttactaattcctcaccaagcaaatatccgtatcatggaagcttctcgcgagcgtttgaatttaccggaagaaaaactgatgaaaacagtgcataaatacggtaatacttcgtcatcttctattgctcttgcgctagttgatgcagtcgaagaaggacgcattaaagataatgacaatgtcctgcttgttggctttggcggcggactaacatggggcgccctaatcattcgttggggtaagtaa

SEQ ID NO: 100 - protein, 312 aa, Listeria monocytogenes W310G variant
  MISC_FEATURE: L. monocytogenes beta ketoacyl-ACP synthase III W310G variant
MNAGILGVGKYVPEKIVTNFDLEKIMDTSDEWIRTRTGIEERRIARDDEYTHDLAYEAAKVAIENAGLTPDDIDLFIVATVTQEATFPSVANIIQDRLGATNAAGMDVEAACAGFTFGVVTAAQFIKTGAYKNIVVVGADKLSKITNWDDRATAVLFGDGAGAVVMGPVSDDHGLLSFDLGSDGSGGKYLNLDENKKIYMNGREVFRFAVRQMGEASLRVLERAGLEKEELDLLIPHQANIRIMEASRERLNLPEEKLMKTVHKYGNTSSSSIALALVDAVEEGRIKDNDNVLLVGFGGGLTWGALIIRGGK

SEQ ID NO: 101 - DNA, 939 bp, Listeria monocytogenes W310G variant
  misc_feature: Encodes L. monocytogenes beta ketoacyl-ACP synthase III W310G variant
atgaacgcaggaattttaggagtaggtaaatacgtacctgaaaaaatagtaacaaattttgatttagaaaaaataatggatacatccgatgagtggattcgtactcgaactggtattgaagaaagaagaattgctcgtgatgacgaatatacgcacgacttagcatacgaagcagcaaaggtagctattgagaatgctgggcttacaccagatgacattgacttatttattgttgccactgtgacgcaggaagcgacttttccatccgttgcgaatattattcaagaccgtttaggagcaacaaatgctgcgggtatggacgtggaagcggcatgtgccggttttacttttggcgtagtaactgcagcacaatttattaaaacaggggcatacaagaatatcgtcgtagttggtgcggataaattatctaaaatcactaactgggatgatcgcgcaacagccgtattatttggtgatggagcgggagccgttgttatgggtccggtttctgatgaccatggactactttcgtttgacttaggctcagatggatctggcggcaaatacttgaacttagatgaaaataagaagatttatatgaatggacgtgaagtgttccgttttgcagttcgccaaatgggagaagcttcgttacgagtacttgaacgtgctggacttgaaaaagaagaattggatttactaattcctcaccaagcaaatatccgtatcatggaagcttctcgcgagcgtttgaatttaccggaagaaaaactgatgaaaacagtgcataaatacggtaatacttcgtcatcttctattgctcttgcgctagttgatgcagtcgaagaaggacgcattaaagataatgacaatgtcctgcttgttggctttggcggcggactaacatggggcgccctaatcattcgtgggggtaagtaa

SEQ ID NO: 102 - protein, 334 aa, Bacteroides vulgatus
  MISC_FEATURE: beta ketoacyl-ACP synthase III
MEKINAVITGVGGYVPDYVLTNEEISRMVDTNDEWIMTRIGVKERRILNEEGLGTSYMARKAAKQLMQKTASNPDDIDAVIVATTTPDYHFPSTASILCDKLGLKNAFAFDLQAACCGFLYLMETAASLIASGRHKKIIIVGADKMSSMVNYQDRATCPIFGDGAAACMVEATTEDYGIMDSILRTDGKGLPFLHMKAGGSVCPPSYFTVDHKMHYLYQEGRTVFKYAVSNMSDITATIAEKNGLNKDNIDWVIPHQANLRIIDAVASRLEVPLEKVMINIQRYGNTSGATLPLCLWDYEKQLKKGDNLIFTAFGAGFTYGAVYVKWGYDGSKR

SEQ ID NO: 103 - DNA, 1005 bp, Bacteroides vulgatus
  misc_feature: Encodes beta ketoacyl-ACP synthase III
ttatctcttactaccatcgtaaccccatttcacataaacggctccataggtaaaacctgcgccgaaagctgtaaatatcaggttatctcctttcttcagctgcttttcgtaatcccaaagacacaacggaagtgtagcaccactggtattaccatatcgctgaatattaatcattaccttttccaagggaacttccaagcgagaggctaccgcatcaataatacgcagattagcctgatgaggaattacccagtcgatattatctttattcaaaccattcttttcggcaatagtcgctgtaatatccgacatattggaaacagcatatttaaatactgttcttccttcctgataaagataatgcatcttatgatcaacagtgaaataagaaggaggacatacagaaccaccggctttcatgtgaagaaaaggaagtcccttaccatctgtacgaagaatagaatccataataccataatcttctgtagtagcttccaccatacatgctgctgcaccatcaccaaagatagggcaagttgcacgatcctggtagtttaccatagatgacatcttatctgcaccgacaataataatctttttatgtcttcccgatgcgataagtgaagcagcagtttccattaaatacaaaaagccgcagcaggcagcctgcaaatcaaatgcaaatgcatttttcaatcccagcttatcacacaggatagaagcagtggaagggaaatgatagtcaggagtagtagttgctacgattactgcatcaatgtcatccggattagaagctgttttctgcatcagttgtttggcagccttacgcgccatatacgatgtacctaatccttcttcattcagaatacgtctttctttaactccgattcgagtcataatccattcatcattggtatctaccattcttgaaatctcttcgttagtcaagacataatctggtacatatccaccgactcctgttattactgcatttattttttccat

SEQ ID NO: 104 - protein, 325 aa, Clostridium acetobutylicum
  MISC_FEATURE: beta ketoacyl-ACP synthase III
MNSVEIIGTGSYVPEKIVTNEDMSKIVDTSDEWISSRTGIKERRISINENTSDLGAKAALRAIEDSNIKPEEIDLIIVATTSPDSYTPSVACIVQEKIGAKNAACFDLNAACTGFIFALNTASQFIKTGEYKTALVVGTEVLSKILDWQDRGTCVLFGDGAGAVIIRGGDENGIIKACLGSDGTGKDFLHCPATNVINPFSDEKGLASSKISMNGREVFKFAVKVMVSSVKKVIEDSGLNIEDIDYIVPHQANIRIIEFAAKKLGLSMDKFFINLQNYGNTSGATIPLAIDEMNKKGLLKRGAKIVVVGFGGGLTWGSMVLKWTK

SEQ ID NO: 105 - DNA, 978 bp, Clostridium acetobutylicum
  misc_feature: Encodes beta ketoacyl-ACP synthase III
ttatttagtccatttaagaaccatggaaccccaagtaagtcctccaccaaaaccaactacaactattttagcacctcttttaagcaagccttttttattcatttcatctattgccagtggtatagtcgctccagatgtatttccatagttttgtaggtttataaaaaatttgtccatacttaatccaagttttttagctgcaaactctattattctaatgttagcctgatgaggtactatataatcaatgtcttctatatttagtccactatcttctataacctttttaactgagcttaccattaccttaactgcaaatttaaagacttctcttccattcatagaaatcttactgcttgctaaacctttttcatccgaaaatggatttatcacattagtcgctggacaatgcaagaagtcttttcccgtaccatctgaaccaagacatgctttaataattccgttttcatctccgcctcttataattaccgcacctgcaccatctccaaaaagtacacatgtacctctatcttgccaatcaagtatctttgatagtacctctgttcctactacaagagctgttttatactctcctgtttttataaactgagatgccgtattaagagcaaatataaatccagtacatgccgcattcaaatcaaaacaggcagcatttttggcacctatcttctcctgaacaatacaagctacggatggagtatatgagtctggacttgtagttgcaactattattaaatctatttcttctggttttatgtttgagtcctctattgcccttaaggcagctttagcacctaaatctgatgtattttcgtttatagatattcttctttcctttatacctgttcttgatgatatccactcatcactagtatcaactatcttagacatatcttcattagtaactattttttctgggacatagcttccagtccctataatctcaacactattcac

SEQ ID NO: 106 - protein, 332 aa, Flavobacterium johnsoniae
  MISC_FEATURE: beta ketoacyl-ACP synthase III
MNTITAAITAVGGYVPDFVLSNKVLETMVDTNDEWITTRTGIKERRILKDADKGTSYLAIQAAQDLIAKANIDPLEIDMVIMATATPDMMVASTGVYVATEIGAVNAFAYDLQAACSSFLYGMSTAAAYVQSGRYKKVLLIGADKMSSIVDYTDRATCIIFGDGAGAVLFEPNYEGLGLQDEYLRSDGVGRDFLKIPAGGSLIPASEDTVKNRQHNIMQDGKTVFKYAVTNMADASELILQRNNLTNQDVDWLVPHQANKRIIDATAGRLELEESKVLVNIERYGNTTSGTLPLVLSDFENQFKKGDNIILAAFGGGFTWGSIYLKWAYDKK

SEQ ID NO: 107 - DNA, 999 bp, Flavobacterium johnsoniae
  misc_feature: Encodes beta ketoacyl-ACP synthase III
ttatttcttatcgtaagcccattttaggtaaatagatccccaagtgaatccacctccaaatgctgctaaaataatattatctccttttttgaattgattttcaaaatcgcttaataccaaaggtaatgttcctgaagttgtattaccatatctttcgatattaactagtactttagactcttctaactctagtcttcctgcagttgcatcgatgatgcgtttgtttgcctggtgaggcactaaccaatcaacatcctgattagttaaattgtttctttgcaagattagttcgctggcatcagccatattggttacagcatatttaaaaactgttttaccatcctgcataatattgtgttgtctgttttttacagtatcttctgaagctggaattaaagatcctccagctggtattttaagaaaatcgcgtcctacaccatcacttcttaaatattcgtcttgcagaccaagaccttcgtaatttggctcaaacaaaactgcccctgctccatcaccaaaaataatacaagttgctctgtctgtgtaatctacaattgatgacattttatcggcaccaattaaaagaacttttttatatcttccagattgtacataagccgcagcagtagacattccgtataagaaacttgaacaagctgcctgcaaatcgtatgcaaatgcattaacagctccaatttctgttgcaacataaactcctgttgaagctaccatcatatctggtgttgcagttgccataataaccatatcaatttcaagaggatcaatattagcttttgctattaaatcctgtgctgcttgtatggcaaggtaagatgtacctttatcagcatctttaagaattcttctttctttaattcctgtacgagtggtaatccattcgtcattggtatctaccattgtttccaacactttgtttgaaagcacaaagtctggaacgtagcctccaacagcggtaattgcggctgtgattgtattcat

SEQ ID NO: 108 - protein, 350 aa, Micrococcus luteus
  MISC_FEATURE: beta ketoacyl-ACP synthase III
MTVTLKQHERPAASRIVAVGAYRPANLVPNEDLIGPIDSSDEWIRQRTGIVTRQRATAEETVPVMAVGAAREALERAGLQGSDLDAVIVSTVTFPHATPSAAALVAHEIGATPAPAYDVSAACAGYCYGVAQADALVRSGTARHVLVVGVERLSDVVDPTDRSISFLLGDGAGAVIVAASDEPGISPSVWGSDGERWSTISMTHSQLELRDAVEHARTTGDASAITGAEGMLWPTLRQDGPSVFRWAVWSMAKVAREALDAAGVEPEDLAAFIPHQANMRIIDEFAKQLKLPESVVVARDIADAGNTSAASIPLAMHRLLEENPELSGGLALQIGFGAGLVYGAQVVRLP

SEQ ID NO: 109 - DNA, 1053 bp, Micrococcus luteus
  misc_feature: Encodes beta ketoacyl-ACP synthase III
tcaggggaggcggaccacctgggcgccgtagaccagcccggcaccgaagccgatctgcagggccagaccgccggagagctcggggttctcctccagcagccggtgcatggccagcgggatggacgcggccgacgtgttgccggcgtccgcgatgtcccgggccacgacgacggactccggcagcttcagctgcttggcgaactcgtcgatgatccgcatgttggcctggtgcgggatgaacgcggcgaggtcctcgggctccacgcccgcggcgtcaagggcctcgcgggccaccttcgccatcgaccacacggcccaacggaagacggagggcccgtcctggcgcagcgtgggccagagcatcccctctgcgccggtgatcgccgaggcgtcgcccgtggtgcgggcgtgctccacggcatcgcgcagctccagctgcgagtgcgtcatggagatcgtggaccagcgctccccgtccgagccccacaccgagggggagatgcccggctcgtccgaggccgcgacgatcacggcgcccgcgccgtcgcccagcaggaaggagatggagcggtccgtgggatccacgacgtcggagaggcgctcgacgccgaccacgagcacgtgccgcgcggtgccggagcgcacgagcgcgtcggcctgggccacgccgtagcagtagccggcgcacgcggcggagacgtcgtaggcgggcgccggggtggcgccgatctcgtgcgccacgagggccgcggccgagggggtggcgtgcgggaaggtgacggtcgagacgatcacggcgtccaggtccgagccctgcaggccggcccgctcgagggcctcccgggcggcgcccacggccatgacgggcacggtctcctccgccgtggcgcgctggcgtgtgacgatgccggtgcgctggcggatccactcgtccgacgagtcgatggggccgatgaggtcctcgttcgggaccaggttcgccgggcggtaggcgcccacggccacgatgcggctggccgcggggcgctcgtgctgcttcagggtgacggtcat

SEQ ID NO: 110 - protein, 17 aa, Artificial sequence
  Synthetic polypeptide
  MISC_FEATURE: FabH motif
  VARIANT (3)..(3): Xaa is Asn or Ser
  VARIANT (5)..(5): Xaa is Ala or Glu
  VARIANT (8)..(9): Xaa is any amino acid
  VARIANT (10)..(10): Xaa is Met or Arg
  VARIANT (14)..(14): Xaa is any amino acid
  VARIANT (15)..(15): Xaa is Asn or Glu
  VARIANT (17)..(17): Xaa is Arg or His
DTXDXWIXXXTGIXXRX

SEQ ID NO: 111 - protein, 18 aa, Artificial sequence
  Synthetic polypeptide
  MISC_FEATURE: FabH motif
  VARIANT (1)..(1): Xaa is Ser or Ala
  VARIANT (2)..(2): Xaa is any amino acid
  VARIANT (4)..(5): Xaa is any amino acid
  VARIANT (7)..(7): Xaa is Ala or Val
  VARIANT (9)..(9): Xaa is Ala or Ser
  VARIANT (12)..(14): Xaa is any amino acid
  VARIANT (15)..(15): Xaa is Met or Leu
  VARIANT (16)..(17): Xaa is any amino acid
XXDXXAXCXGFXXXXXXA

SEQ ID NO: 112 - protein, 15 aa, Artificial sequence
  Synthetic polypeptide
  MISC_FEATURE: FabH motif
  VARIANT (3)..(3): Xaa is any amino acid
  VARIANT (5)..(5): Xaa is Ala or Ile
  VARIANT (6)..(6): Xaa is Ile or Val
  VARIANT (7)..(7): Xaa is any amino acid
  VARIANT (9)..(9): Xaa is Ala or Gly
  VARIANT (13)..(13): Xaa is Ala or Gly
  VARIANT (14)..(14): Xaa is Gly or Ala
  VARIANT (15)..(15): Xaa is Ala or Val
DRXTXXXFXDGAXXX

SEQ ID NO: 113 - protein, 8 aa, Artificial sequence
  Synthetic polypeptide
  MISC_FEATURE: FabH motif
  VARIANT (5)..(5): Xaa is any amino acid
  VARIANT (8)..(8): Xaa is Met or Leu
HQANXRIX

SEQ ID NO: 114 - protein, 19 aa, Artificial sequence
  Synthetic polypeptide
  MISC_FEATURE: FabH motif
  VARIANT (4)..(4): Xaa is Gly or Ser
  VARIANT (8)..(8): Xaa is Val or Ile
  VARIANT (10)..(11): Xaa is any amino acid
  VARIANT (12)..(12): Xaa is Ile or Leu
  VARIANT (13)..(18): Xaa is any amino acid
GNTXAASXPXXXXXXXXXG

SEQ ID NO: 115 - protein, 13 aa, Artificial sequence
  Synthetic polypeptide
  MISC_FEATURE: FabH motif
  VARIANT (1)..(1): Xaa is Ile or Val
  VARIANT (2)..(2): Xaa is any amino acid
  VARIANT (4)..(5): Xaa is any amino acid
  VARIANT (10)..(10): Xaa is Leu or Phe
  VARIANT (11)..(11): Xaa is Thr or Ser
XXLXXFGGGXXWG

SEQ ID NO: 116 - protein, 820 aa, Escherichia coli
  MISC_FEATURE: aspartokinase I and homoserine dehydrogenase I (EcThrA)
MRVLKFGGTSVANAERFLRVADILESNARQGQVATVLSAPAKITNHLVAMIEKTISGQDALPNISDAERIFAELLTGLAAAQPGFPLAQLKTFVDQEFAQIKHVLHGISLLGQCPDSINAALICRGEKMSIAIMAGVLEARGHNVTVIDPVEKLLAVGHYLESTVDIAESTRRIAASRIPADHMVLMAGFTAGNEKGELVVLGRNGSDYSAAVLAACLRADCCEIWTDVDGVYTCDPRQVPDARLLKSMSYQEAMELSYFGAKVLHPRTITPIAQFQIPCLIKNTGNPQAPGTLIGASRDEDELPVKGISNLNNMAMFSVSGPGMKGMVGMAARVFAAMSRARISVVLITQSSSEYSISFCVPQSDCVRAERAMQEEFYLELKEGLLEPLAVTERLAIISVVGDGMRTLRGISAKFFAALARANINIVAIAQGSSERSISVVVNNDDATTGVRVTHQMLFNTDQVIEVFVIGVGGVGGALLEQLKRQQSWLKNKHIDLRVCGVANSKALLTNVHGLNLENWQEELAQAKEPFNLGRLIRLVKEYHLLNPVIVDCTSSQAVADQYADFLREGFHVVTPNKKANTSSMDYYHQLRYAAEKSRRKFLYDTNVGAGLPVIENLQNLLNAGDELMKFSGILSGSLSYIFGKLDEGMSFSEATTLAREMGYTEPDPRDDLSGMDVARKLLILARETGRELELADIEIEPVLPAEFNAEGDVAAFMANLSQLDDLFAARVAKARDEGKVLRYVGNIDEDGVCRVKIAEVDGNDPLFKVKNGENALAFYSHYYQPLPLVLRGYGAGNDVTAAGVFADLLRTLSWKLGV

SEQ ID NO: 117 - DNA, 2463 bp, Escherichia coli
  misc_feature: Encodes aspartokinase I and homoserine dehydrogenase I (EcThrA)
atgcgagtgttgaagttcggcggtacatcagtggcaaatgcagaacgttttctgcgtgttgccgatattctggaaagcaatgccaggcaggggcaggtggccaccgtcctctctgcccccgccaaaatcaccaaccacctggtggcgatgattgaaaaaaccattagcggccaggatgctttacccaatatcagcgatgccgaacgtatttttgccgaacttttgacgggactcgccgccgcccagccggggttcccgctggcgcaattgaaaactttcgtcgatcaggaatttgcccaaataaaacatgtcctgcatggcattagtttgttggggcagtgcccggatagcatcaacgctgcgctgatttgccgtggcgagaaaatgtcgatcgccattatggccggcgtattagaagcgcgcggtcacaacgttactgttatcgatccggtcgaaaaactgctggcagtggggcattacctcgaatctaccgtcgatattgctgagtccacccgccgtattgcggcaagccgcattccggctgatcacatggtgctgatggcaggtttcaccgccggtaatgaaaaaggcgaactggtggtgcttggacgcaacggttccgactactctgctgcggtgctggctgcctgtttacgcgccgattgttgcgagatttggacggacgttgacggggtctatacctgcgacccgcgtcaggtgcccgatgcgaggttgttgaagtcgatgtcctaccaggaagcgatggagctttcctacttcggcgctaaagttcttcacccccgcaccattacccccatcgcccagttccagatcccttgcctgattaaaaataccggaaatcctcaagcaccaggtacgctcattggtgccagccgtgatgaagacgaattaccggtcaagggcatttccaatctgaataacatggcaatgttcagcgtttctggtccggggatgaaagggatggtcggcatggcggcgcgcgtctttgcagcgatgtcacgcgcccgtatttccgtggtgctgattacgcaatcatcttccgaatacagcatcagtttctgcgttccacaaagcgactgtgtgcgagctgaacgggcaatgcaggaagagttctacctggaactgaaagaaggcttactggagccgctggcagtgacggaacggctggccattatctcggtggtaggtgatggtatgcgcaccttgcgtgggatctcggcgaaattctttgccgcactggcccgcgccaatatcaacattgtcgccattgctcagggatcttctgaacgctcaatctctgtcgtggtaaataacgatgatgcgaccactggcgtgcgcgttactcatcagatgctgttcaataccgatcaggttatcgaagtgtttgtgattggcgtcggtggcgttggcggtgcgctgctggagcaactgaagcgtcagcaaagctggctgaagaataaacatatcgacttacgtgtctgcggtgttgccaactcgaaggctctgctcaccaatgtacatggccttaatctggaaaactggcaggaagaactggcgcaagccaaagagccgtttaatctcgggcgcttaattcgcctcgtgaaagaatatcatctgctgaacccggtcattgttgactgcacttccagccaggcagtggcggatcaatatgccgacttcctgcgcgaaggtttccacgttgtcacgccgaacaaaaaggccaacacctcgtcgatggattactaccatcagttgcgttatgcggcggaaaaatcgcggcgtaaattcctctatgacaccaacgttggggctggattaccggttattgagaacctgcaaaatctgctcaatgcaggtgatgaattgatgaagttctccggcattctttctggttcgctttcttatatcttcggcaagttagacgaaggcatgagtttctccgaggcgaccacgctggcgcgggaaatgggttataccgaaccggacccgcgagatgatctttctggtatggatgtggcgcgtaaactattgattctcgctcgtgaaacgggacgtgaactggagctggcggatattgaaattgaacctgtgctgcccgcagagtttaacgccgagggtgatgttgccgcttttatggcgaatctgtcacaactcgacgatctctttgccgcgcgcgtggcgaaggcccgtgatgaaggaaaagttttgcgctatgttggcaatattgatgaagatggcgtctgccgcgtgaagattgccgaagtggatggtaatgatccgctgttcaaagtgaaaaatggcgaaaacgccctggccttctatagccactattatcagccgctgccgttggtactgcgcggatatggtgcgggcaatgacgttacagctgccggtgtctttgctgatctgctacgtaccctctcatggaagttaggagtctga

SEQ ID NO: 118 - protein, 820 aa, Escherichia coli S345F variant
  MISC_FEATURE: Escherichia coli  ThrA S345F variant
MRVLKFGGTSVANAERFLRVADILESNARQGQVATVLSAPAKITNHLVAMIEKTISGQDALPNISDAERIFAELLTGLAAAQPGFPLAQLKTFVDQEFAQIKHVLHGISLLGQCPDSINAALICRGEKMSIAIMAGVLEARGHNVTVIDPVEKLLAVGHYLESTVDIAESTRRIAASRIPADHMVLMAGFTAGNEKGELVVLGRNGSDYSAAVLAACLRADCCEIWTDVDGVYTCDPRQVPDARLLKSMSYQEAMELSYFGAKVLHPRTITPIAQFQIPCLIKNTGNPQAPGTLIGASRDEDELPVKGISNLNNMAMFSVSGPGMKGMVGMAARVFAAMSRARIFVVLITQSSSEYSISFCVPQSDCVRAERAMQEEFYLELKEGLLEPLAVTERLAIISVVGDGMRTLRGISAKFFAALARANINIVAIAQGSSERSISVVVNNDDATTGVRVTHQMLFNTDQVIEVFVIGVGGVGGALLEQLKRQQSWLKNKHIDLRVCGVANSKALLTNVHGLNLENWQEELAQAKEPFNLGRLIRLVKEYHLLNPVIVDCTSSQAVADQYADFLREGFHVVTPNKKANTSSMDYYHQLRYAAEKSRRKFLYDTNVGAGLPVIENLQNLLNAGDELMKFSGILSGSLSYIFGKLDEGMSFSEATTLAREMGYTEPDPRDDLSGMDVARKLLILARETGRELELADIEIEPVLPAEFNAEGDVAAFMANLSQLDDLFAARVAKARDEGKVLRYVGNIDEDGVCRVKIAEVDGNDPLFKVKNGENALAFYSHYYQPLPLVLRGYGAGNDVTAAGVFADLLRTLSWKLGV

SEQ ID NO: 119 - DNA, 2463 bp, Escherichia coli S345F variant
  misc_feature: Encodes Escherichia coli  ThrA S345F variant
atgcgagtgttgaagttcggcggtacatcagtggcaaatgcagaacgttttctgcgtgttgccgatattctggaaagcaatgccaggcaggggcaggtggccaccgtcctctctgcccccgccaaaatcaccaaccacctggtggcgatgattgaaaaaaccattagcggccaggatgctttacccaatatcagcgatgccgaacgtatttttgccgaacttttgacgggactcgccgccgcccagccggggttcccgctggcgcaattgaaaactttcgtcgatcaggaatttgcccaaataaaacatgtcctgcatggcattagtttgttggggcagtgcccggatagcatcaacgctgcgctgatttgccgtggcgagaaaatgtcgatcgccattatggccggcgtattagaagcgcgcggtcacaacgttactgttatcgatccggtcgaaaaactgctggcagtggggcattacctcgaatctaccgtcgatattgctgagtccacccgccgtattgcggcaagccgcattccggctgatcacatggtgctgatggcaggtttcaccgccggtaatgaaaaaggcgaactggtggtgcttggacgcaacggttccgactactctgctgcggtgctggctgcctgtttacgcgccgattgttgcgagatttggacggacgttgacggggtctatacctgcgacccgcgtcaggtgcccgatgcgaggttgttgaagtcgatgtcctaccaggaagcgatggagctttcctacttcggcgctaaagttcttcacccccgcaccattacccccatcgcccagttccagatcccttgcctgattaaaaataccggaaatcctcaagcaccaggtacgctcattggtgccagccgtgatgaagacgaattaccggtcaagggcatttccaatctgaataacatggcaatgttcagcgtttctggtccggggatgaaagggatggtcggcatggcggcgcgcgtctttgcagcgatgtcacgcgcccgtattttcgtggtgctgattacgcaatcatcttccgaatacagcatcagtttctgcgttccacaaagcgactgtgtgcgagctgaacgggcaatgcaggaagagttctacctggaactgaaagaaggcttactggagccgctggcagtgacggaacggctggccattatctcggtggtaggtgatggtatgcgcaccttgcgtgggatctcggcgaaattctttgccgcactggcccgcgccaatatcaacattgtcgccattgctcagggatcttctgaacgctcaatctctgtcgtggtaaataacgatgatgcgaccactggcgtgcgcgttactcatcagatgctgttcaataccgatcaggttatcgaagtgtttgtgattggcgtcggtggcgttggcggtgcgctgctggagcaactgaagcgtcagcaaagctggctgaagaataaacatatcgacttacgtgtctgcggtgttgccaactcgaaggctctgctcaccaatgtacatggccttaatctggaaaactggcaggaagaactggcgcaagccaaagagccgtttaatctcgggcgcttaattcgcctcgtgaaagaatatcatctgctgaacccggtcattgttgactgcacttccagccaggcagtggcggatcaatatgccgacttcctgcgcgaaggtttccacgttgtcacgccgaacaaaaaggccaacacctcgtcgatggattactaccatcagttgcgttatgcggcggaaaaatcgcggcgtaaattcctctatgacaccaacgttggggctggattaccggttattgagaacctgcaaaatctgctcaatgcaggtgatgaattgatgaagttctccggcattctttctggttcgctttcttatatcttcggcaagttagacgaaggcatgagtttctccgaggcgaccacgctggcgcgggaaatgggttataccgaaccggacccgcgagatgatctttctggtatggatgtggcgcgtaaactattgattctcgctcgtgaaacgggacgtgaactggagctggcggatattgaaattgaacctgtgctgcccgcagagtttaacgccgagggtgatgttgccgcttttatggcgaatctgtcacaactcgacgatctctttgccgcgcgcgtggcgaaggcccgtgatgaaggaaaagttttgcgctatgttggcaatattgatgaagatggcgtctgccgcgtgaagattgccgaagtggatggtaatgatccgctgttcaaagtgaaaaatggcgaaaacgccctggccttctatagccactattatcagccgctgccgttggtactgcgcggatatggtgcgggcaatgacgttacagctgccggtgtctttgctgatctgctacgtaccctctcatggaagttaggagtctga

SEQ ID NO: 120 - protein, 404 aa, Bacillus subtilis
  MISC_FEATURE: aspartate kinase
MKIIVQKFGGTSVKDDKGRKLALGHIKEAISEGYKVVVVVSAMGRKGDPYATDSLLGLLYGDQSAISPREQDLLLSCGETISSVVFTSMLLDNGVKAAALTGAQAGFLTNDQHTNAKIIEMKPERLFSVLANHDAVVVAGFQGATEKGDTTTIGRGGSDTSAAALGAAVDAEYIDIFTDVEGVMTADPRVVENAKPLPVVTYTEICNLAYQGAKVISPRAVEIAMQAKVPIRVRSTYSNDKGTLVTSHHSSKVGSDVFERLITGIAHVKDVTQFKVPAKIGQYNVQTEVFKAMANAGISVDFFNITPSEIVYTVAGNKTETAQRILMDMGYDPMVTRNCAKVSAVGAGIMGVPGVTSKIVSALSEKEIPILQSADSHTTIWVLVHEADMVPAVNALHEVFELSK

SEQ ID NO: 121 - DNA, 1215 bp, Bacillus subtilis
  misc_feature: Encodes aspartate kinase
gtgaagataattgttcaaaagttcggcggaacatcagtaaaagatgataaaggccgcaaactggctttagggcatattaaagaagcaatcagtgaaggatataaggttgtcgttgtcgtttcagcgatgggccgaaaaggggacccgtatgcaacagattctttgctcgggctgctttacggcgatcagtcagcgatttctcctagggagcaggatttgcttttatcttgcggagagactatttcctctgtcgtctttacaagcatgctgcttgataacggtgtgaaagcagctgcgctgacaggggctcaggctggctttttaacgaatgatcagcatactaatgcgaaaatcattgaaatgaaaccggagcgtttattcagtgtgctcgccaatcatgatgcggtagtcgtcgcaggcttccagggcgcaactgaaaagggtgatacaacaacaatcggcagagggggcagcgatacgtctgcagccgcactcggagcagctgttgatgcggaatacatcgatattttcaccgatgtagaaggcgtgatgactgctgacccaagagtggtagaaaatgcaaaaccgcttcctgttgtgacgtatacggaaatctgcaacctggcgtatcagggggccaaggtcatttctccgcgtgctgtggaaatcgcaatgcaggccaaggttccgatccgcgtccgttcgacttattcgaatgataaaggcacattggtgacatcacatcactcttccaaggtcggcagtgatgtttttgaaaggctgattacgggaatcgcccatgtcaaagatgtcacgcagttcaaagtgcctgcgaaaatcggccagtataacgttcagactgaagtgttcaaggctatggcaaacgctggaatcagtgtcgatttctttaacattacacctagtgaaatcgtctatacggtagccggaaataaaacagaaacagctcagcgtattttaatggatatgggctatgatccaatggtgacgagaaactgcgcgaaggtatcggcggtcggcgcgggcattatgggtgttcccggtgttacgtccaaaattgtatcggctctttcagaaaaagaaattccgatccttcagtcggctgacagccatacgacgatatgggtgctcgtccatgaagcggatatggttcctgctgtaaacgctttgcatgaagtgtttgaactttcgaagtaa

SEQ ID NO: 122 - protein, 411 aa, Pseudomonas putida
  MISC_FEATURE: aspartate kinase
MALIVQKFGGTSVGSIERIEQVAEKVKKHREAGDDLVVVLSAMSGETNRLIDLAKQITDQPVPRELDVIVSTGEQVTIALLTMALIKRGVPAVSYTGNQVRILTDSSHNKARILQIDDQKIRADLKEGRVVVVAGFQGVDEHGSITTLGRGGSDTTGVALAAALKADECQIYTDVDGVYTTDPRVVPQARRLEKITFEEMLEMASLGSKVLQIRSVEFAGKYNVPLRVLHSFKEGPGTLITIDEEESMEQPIISGIAFNRDEAKLTIRGVPDTPGVAFKILGPISASNIEVDMIVQNVAHDNTTDFTFTVHRNEYEKAQSVLENTAREIGAREVIGDTKIAKVSIVGVGMRSHAGVASCMFEALAKESINIQMISTSEIKVSVVLEEKYLELAVRALHTAFDLDAPARQGE

SEQ ID NO: 123 - DNA, 1236 bp, Pseudomonas putida
  misc_feature: Encodes aspartate kinase
atggcgttgatcgtacagaaatttggcggcacctctgtcggttccatcgagcggatcgagcaggtagccgaaaaggtcaagaaacaccgtgaagcgggcgacgacctggtggttgtgctgtcggccatgagcggtgaaaccaatcgcctgatcgacttggccaagcagatcaccgatcagccggttcctcgtgaactggacgtgatcgtgtcgacgggtgagcaggtcaccattgccctgctgaccatggccttgatcaagcgtggtgtgccagcggtgtcctacaccggcaaccaggtgcgtattctcaccgacagctcgcacaacaaggcgcgcattctgcaaatcgacgaccagaagattcgtgccgacctcaaggaaggtcgcgtggtcgtggttgcaggcttccagggtgtcgacgagcacggcagcatcactaccctgggtcgtggtggctctgataccaccggcgtggccctggcggcagcgctgaaggctgatgagtgccagatctacactgatgttgatggcgtctacaccaccgacccgcgcgtcgtgccacaggctcgtcgcctggagaagatcaccttcgaagagatgctggaaatggccagcctcggttccaaggtgctgcagatccgttcggtggagttcgccggcaagtacaacgttccgctgcgcgtgctgcacagcttcaaggagggtccgggtaccctcattaccattgatgaagaggaatccatggaacagccgatcatttccggtatcgccttcaaccgtgatgaagcaaagctgaccattcgcggcgtgccggataccccgggcgtggccttcaagatcctcggcccgatcagcgcttcgaacatcgaagtcgacatgatcgtgcagaacgttgctcacgataacaccaccgacttcaccttcaccgtgcaccgcaatgagtacgagaaggcgcagagcgtgctggaaaacactgcgcgcgaaatcggtgcccgtgaagtgatcggcgacaccaagatcgccaaggtctcgatcgttggcgtcggcatgcgttcgcacgccggtgttgccagctgcatgttcgaagccctggccaaggagagcatcaacatccagatgatctccacttccgagatcaaggtttcggtggtgctcgaagagaagtacctggagctggccgtgcgcgcgctgcataccgcgttcgatctggatgctcctgcccgacagggcgagtaa

SEQ ID NO: 124 - protein, 527 aa, Saccharomyces cerevisiae
  MISC_FEATURE: aspartate kinase
MPMDFQPTSSHSNWVVQKFGGTSVGKFPVQIVDDIVKHYSKPDGPNNNVAVVCSARSSYTKAEGTTSRLLKCCDLASQESEFQDIIEVIRQDHIDNADRFILNPALQAKLVDDTNKELELVKKYLNASKVLGEVSSRTVDLVMSCGEKLSCLFMTALCNDRGCKAKYVDLSHIVPSDFSASALDNSFYTFLVQALKEKLAPFVSAKERIVPVFTGFFGLVPTGLLNGVGRGYTDLCAALIAVAVNADELQVWKEVDGIFTADPRKVPEARLLDSVTPEEASELTYYGSEVIHPFTMEQVIRAKIPIRIKNVQNPLGNGTIIYPDNVAKKGESTPPHPPENLSSSFYEKRKRGATAITTKNDIFVINIHSNKKTLSHGFLAQIFTILDKYKLVVDLISTSEVHVSMALPIPDADSLKSLRQAEEKLRILGSVDITKKLSIVSLVGKHMKQYIGIAGTMFTTLAEEGINIEMISQGANEINISCVINESDSIKALQCIHAKLLSERTNTSNQFEHAIDERLEQLKRLGI

SEQ ID NO: 125 - DNA, 1584 bp, Saccharomyces cerevisiae
  misc_feature: Encodes aspartate kinase
atgccaatggatttccaacctacatcaagtcattcgaactgggtcgtgcaaaagttcggtggtacatctgtcggtaaatttcccgtccaaatagtggatgacattgtgaagcactattctaaacctgacggcccaaacaataatgtcgctgtcgtttgttccgcccgttcttcatacaccaaggctgaaggtaccacttctcgtcttttgaaatgttgtgatttggcttcgcaagaatctgaatttcaagacattatcgaagttatcagacaagaccatatcgataatgccgaccgcttcattctcaatcctgccttgcaagccaagttagtggatgataccaataaagaacttgaactggtcaagaaatatttaaatgcttcaaaagttttgggtgaagtgagttcacgtacagtagatctggtgatgtcatgtggtgagaagttgagttgtttgttcatgactgctttatgtaatgaccgtggctgtaaggccaaatatgtggatttgagccacattgttccctctgatttcagtgccagcgctttggataacagtttctacactttcctggttcaagcattgaaagaaaaattggccccctttgtaagtgctaaagagcgtatcgttccagtctttacagggttttttggtttagttccaactggtcttctgaatggtgttggtcgtggctataccgatttatgtgccgctttgatagcagttgctgtaaatgctgatgaactacaagtttggaaggaagttgatggtatatttactgctgatcctcgtaaggttcctgaagcacgtttgctagacagtgttactccagaagaagcttctgaattaacatattatggttccgaagttatacatccttttacgatggaacaagttattagggctaagattcctattagaatcaagaatgttcaaaatccattaggtaacggtaccattatctacccagataatgtagcaaagaagggtgaatctactccaccacatcctcctgagaacttatcctcatctttctatgaaaagagaaagagaggtgccactgctatcaccaccaaaaatgacattttcgtcatcaacattcattccaataagaaaaccctatcccatggtttcctagctcaaatatttaccatcctggataagtacaagttagtcgtagatttaatatctacttctgaagttcatgtttcgatggctttgcccattccagatgcagactcattaaaatctctgagacaagctgaggaaaaattgagaattttaggttctgttgatatcacaaagaagttgtctattgtttcattagttggtaaacatatgaaacaatacatcggcattgctggtaccatgtttactactcttgctgaagaaggcatcaacattgaaatgatttctcaaggggcaaatgaaataaacatatcctgcgttatcaatgaatctgactccataaaagcgctacaatgtattcatgccaagttactaagtgagcggacaaatacttcaaaccaatttgaacatgccattgatgaacgtttagaacaattgaaaagacttggaatttaa

SEQ ID NO: 126 - protein, 433 aa, Bacillus subtilis
  MISC_FEATURE: homoserine dehydrogenase
MKAIRVGLLGLGTVGSGVVKIIQDHQDKLMHQVGCPVTIKKVLVKDLEKKREVDLPKEVLTTEVYDVIDDPDVDVVIEVIGGVEQTKQYLVDALRSKKHVVTANKDLMAVYGSELLAEAKENGCDIYFEASVAGGIPILRTLEEGLSSDRITKMMGIVNGTTNFILTKMIKEKSPYEEVLKEAQDLGFAEADPTSDVEGLDAARKMAILARLGFSMNVDLEDVKVKGISQITDEDISFSKRLGYTMKLIGIAQRDGSKIEVSVQPTLLPDHHPLSAVHNEFNAVYVYGEAVGETMFYGPGAGSMPTATSVVSDLVAVMKNMRLGVTGNSFVGPQYEKNMKSPSDIYAQQFLRIHVKDEVGSFSKITSVFSERGVSFEKILQLPIKGHDELAEIVIVTHHTSEADFSDILQNLNDLEVVQEVKSTYRVEGNGWS

SEQ ID NO: 127 - DNA, 1302 bp, Bacillus subtilis
  misc_feature: Encodes homoserine dehydrogenase
ttagctccaaccgttcccttctacacgatatgtgcttttgacttcttgaacgacttccaaatcatttaggttttgcaggatatcactgaaatcagcttctgatgtatgatgtgtgacaattacgatttcagctaactcatcatggcctttaattggcagctgaaggattttttcaaagctcacgccccgctctgagaacacagatgtaattttcgagaatgaaccaacctcatcttttacatgaattcttaaaaactgctgtgcataaatgtcagacggcgatttcatgtttttctcatattgcggtccgacaaagctgttgccggttacacctaggcgcatatttttcatgacagcgacgaggtcagaaacaacggatgtcgctgtcggcatgcttccggctcccggcccgtagaacatcgtctcaccgacagcctcgccgtatacataaacagcgttaaactcattatgaacagcagaaagcggatgatggtcaggaagcagtgtcggctgtacgctgacctcgattttgctgccgtcacgctgagcaatcccgatcagcttcattgtatagccgaggcgtttgctgaagctgatgtcctcgtctgtaatttgggagatcccctttactttgacgtcttccagatccacgttcatcgagaagccgaggcgcgccaatatcgccattttccgtgcggcgtcaagcccttccacgtcagaagtcggatcagcttcggcaaaaccgagatcctgcgcttccttgagcacttcctcgtatgggcttttctctttgatcattttggttaagataaagtttgttgtgccgttcacaattcccatcatttttgtaattcgatctgatgagaggccttcctctaacgtgcgcagaatcggaatcccgccggcaacactggcttcaaagtagatatcgcatccattttccttcgcttcggcaagcagctcggagccgtacacagccattaagtccttgtttgctgtgacaacatgctttttcgatctcagcgcgtcgaccaaatattgttttgtctgttcaacgccgccgatcacctcgatgacgacatcaacatctggatcatcaatgacatcatacacttctgtcgtgagcacttccttcggcaaatctacttctctctttttctctaaatcttttacaagcactttttttatcgtaaccggacagccgacctgatgcataagcttatcctgatggtcttgaataattttaacgacaccgcttccgacggtacctaaacctaaaagccctacacgaatcgctttcaa

SEQ ID NO: 128 - protein, 434 aa, Pseudomonas putida
  MISC_FEATURE: homoserine dehydrogenase
MKPVKVGICGLGTVGGGTFNVLQRNAEEIARRAGRGIEVAQIAMRSQNPNCQITGTPITADVFEVASNPEIDIVIELIGGYTIARDLVLKAIENGKHVVTANKALIAVHGNEIFAKAREKGVIVAFEAAVAGGIPVIKAIREGLSANRINWLAGIINGTGNFILTEMREKGRAFPDVLAEAQALGYAEADPTFDVEGIDAAHKLTILASIAFGIPLQFDKAYTEGITQLTTADVNYAEALGYRIKHLGVARRTAEGIELRVHPTLIPADRLIANVNGVMNAVMVNGDAAGSTLYYGAGAGMEPTASSVVGDLVDVVRAMTSDPENRVPHLAFQPDSLSAHPILPIEACESAYYLRIQAKDHPGVLAQVASILSERGINIESIMQKEAEEQDGLVPMILVTHGVVEQRINDAIVALEALQDVVGKVVRIRVEQLN

SEQ ID NO: 129 - DNA, 1305 bp, Pseudomonas putida
  misc_feature: Encodes homoserine dehydrogenase
ttagttgagctgctcgacgcgaatgcgcacaaccttgccgaccacgtcctgcagggcttccagggcgacgatggcgtcattgatacgctgctcgaccacgccatgggtcaccaggatcattggcaccaggccatcctgttcctcggcttccttctgcatgatcgactcgatgttgataccgcgctccgagaggatgctggcgacctgggccagtacgcccgggtgatccttggcctggatacgcaggtagtaggcgctttcgcaggcttcgatcggcaggatcgggtgggccgacagcgagtctggctggaaggccaggtgcggcacacggttttccgggtcggaggtcatggcacggaccacgtcgaccaggtcgccgaccactgacgaagcggtaggctccatacccgcgccggcaccgtagtacagggtggagccggcagcatcaccgttgaccatgacagcgttcatcacgccgttgacgttggcgatcagacggtcggccgggatcagcgtcgggtgcacgcgcagctcgataccttcggcggtgcgacgcgccacgcccaggtgcttgatgcggtagcccaacgcctcggcgtagttcacgtctgccgttgtcagctgggtgataccttcggtgtaggccttgtcgaactgcagcgggataccgaacgcgatggacgccaggatcgtcagcttgtgcgcagcgtcaatgccttctacgtcaaaggtcgggtcggcttcggcgtagcccagcgcttgagcttcggccagcacgtccgggaaggcacggcccttctcacgcatttcggtgaggatgaagttgccagtgccgttgatgatgccagccagccagttgatgcggttggccgacaggccttcgcggatggccttgatcaccgggatgccaccggctacggccgcctcgaaagcgacaatcacgcccttctcgcgagctttggcgaagatttcgttgccgtgcacggcaatcagcgccttgttggcagtgaccacgtgcttgccgttttcgatggccttcagcaccaggtcgcgggcgatggtatagccaccgatcagctcgatgacaatgtcgatctccgggttgcttgcaacttcgaacacgtcagcggtaatgggggtaccggtaatctggcagttcgggttctgcgagcgcatggcgatctgtgccacttcaataccgcgcccggcacggcgggcaatctcctcggcgttgcgctgaagtacattgaaggttccgccaccgacggtccccaacccacagatgcctactttgaccggtttcac

SEQ ID NO: 130 - protein, 359 aa, Saccharomyces cerevisiae
  MISC_FEATURE: homoserine dehydrogenase
MSTKVVNVAVIGAGVVGSAFLDQLLAMKSTITYNLVLLAEAERSLISKDFSPLNVGSDWKAALAASTTKTLPLDDLIAHLKTSPKPVILVDNTSSAYIAGFYTKFVENGISIATPNKKAFSSDLATWKALFSNKPTNGFVYHEATVGAGLPIISFLREIIQTGDEVEKIEGIFSGTLSYIFNEFSTSQANDVKFSDVVKVAKKLGYTEPDPRDDLNGLDVARKVTIVGRISGVEVESPTSFPVQSLIPKPLESVKSADEFLEKLSDYDKDLTQLKKEAATENKVLRFIGKVDVATKSVSVGIEKYDYSHPFASLKGSDNVISIKTKRYTNPVVIQGAGAGAAVTAAGVLGDVIKIAQRL

SEQ ID NO: 131 - DNA, 1080 bp, Saccharomyces cerevisiae
  misc_feature: Encodes homoserine dehydrogenase
atgagcactaaagttgttaatgttgccgttatcggtgccggtgttgttggttcagctttcttggatcaattgttagccatgaagtctaccattacttacaatctagttcttttggctgaagctgagcgttctttaatctccaaggacttttctccattaaatgttggttctgattggaaggctgctttagcagcctccactactaaaacgttgcctttggatgatttaattgctcatttgaagacttcacctaagccagtcattttggttgataacacttccagcgcttacattgctggtttttacactaagtttgtcgaaaatggtatttccattgctactccaaacaagaaggccttttcctctgatttggctacctggaaggctcttttctcaaataagccaactaacggttttgtctatcatgaagctaccgtcggtgctggtttgcctatcatcagtttcttaagagaaattattcaaaccggtgacgaagttgaaaaaattgaaggtatcttctctggtactctatcttatattttcaacgagttctccactagtcaagctaacgacgtcaaattctctgatgttgtcaaagttgctaaaaaattgggttatactgaaccagatccaagagatgatttgaatgggttggatgttgctagaaaggttaccattgttggtaggatatctggtgtggaagttgaatctccaacttccttccctgtccagtctttgattccaaaaccattggaatctgtcaagtctgctgatgaattcttggaaaaattatctgattacgataaagatttgactcaattgaagaaggaagctgccactgaaaataaggtattgagattcattggtaaagtcgatgttgccaccaaatctgtgtctgtaggaattgaaaagtacgattactcacacccattcgcatcattgaagggatcagataacgttatttccatcaagactaagcgttacaccaatcctgttgtcattcaaggtgccggtgccggtgctgccgttactgccgctggtgttttgggtgatgttatcaagattgctcaaagactttag

SEQ ID NO: 132 - protein, 310 aa, Escherichia coli
  MISC_FEATURE: homoserine kinase
MVKVYAPASSANMSVGFDVLGAAVTPVDGALLGDVVTVEAAETFSLNNLGRFADKLPSEPRENIVYQCWERFCQELGKQIPVAMTLEKNMPIGSGLGSSACSVVAALMAMNEHCGKPLNDTRLLALMGELEGRISGSIHYDNVAPCFLGGMQLMIEENDIISQQVPGFDEWLWVLAYPGIKVSTAEARAILPAQYRRQDCIAHGRHLAGFIHACYSRQPELAAKLMKDVIAEPYRERLLPGFRQARQAVAEIGAVASGISGSGPTLFALCDKPETAQRVADWLGKNYLQNQEGFVHICRLDTAGARVLEN

SEQ ID NO: 133 - DNA, 933 bp, Escherichia coli
  misc_feature: Encodes homoserine kinase
atggttaaagtttatgccccggcttccagtgccaatatgagcgtcgggtttgatgtgctcggggcggcggtgacacctgttgatggtgcattgctcggagatgtagtcacggttgaggcggcagagacattcagtctcaacaacctcggacgctttgccgataagctgccgtcagaaccacgggaaaatatcgtttatcagtgctgggagcgtttttgccaggaactgggtaagcaaattccagtggcgatgaccctggaaaagaatatgccgatcggttcgggcttaggctccagtgcctgttcggtggtcgcggcgctgatggcgatgaatgaacactgcggcaagccgcttaatgacactcgtttgctggctttgatgggcgagctggaaggccgtatctccggcagcattcattacgacaacgtggcaccgtgttttctcggtggtatgcagttgatgatcgaagaaaacgacatcatcagccagcaagtgccagggtttgatgagtggctgtgggtgctggcgtatccggggattaaagtctcgacggcagaagccagggctattttaccggcgcagtatcgccgccaggattgcattgcgcacgggcgacatctggcaggcttcattcacgcctgctattcccgtcagcctgagcttgccgcgaagctgatgaaagatgttatcgctgaaccctaccgtgaacggttactgccaggcttccggcaggcgcggcaggcggtcgcggaaatcggcgcggtagcgagcggtatctccggctccggcccgaccttgttcgctctgtgtgacaagccggaaaccgcccagcgcgttgccgactggttgggtaagaactacctgcaaaatcaggaaggttttgttcatatttgccggctggatacggcgggcgcacgagtactggaaaactaa

SEQ ID NO: 134 - protein, 309 aa, Bacillus subtilis
  MISC_FEATURE: homoserine kinase
MNEADMLFSVTVPGSTANLGPGFDSVGMALSRYLKLTVFESDKWSFEAETETVAGIPAGTDNLIYQVAKRTADLYGKEMPPVHVKVWSDIPLARGLGSSAAAIVAAIELADELCGLKLSEADKLHLASLEEGHPDNAGASLVGGLVIGLHEDDETQMIRVPNADIDVVVVIPFYEVLTRDARDVLPKEFPYADAVKASAVSNILIAAIMSKDWPLVGKIMKKDMFHQPYRAMLVPELSKVEHVAEMKGAYGTALSGAGPTILVMTEKGKGEELKEQLALHFPHCEVDALTVPKEGSIIERNPLYQVKSV

SEQ ID NO: 135 - DNA, 930 bp, Bacillus subtilis
  misc_feature: Encodes homoserine kinase
ctatacactttttacttgatataaaggatttcgctctattatacttccctctttcggaacggtcaaagcgtctacttcacaatgagggaaatgaagcgcgagctgttcttttagctcttctccctttcctttttcggtcatgacgagaatcgttgggcctgctccgctgagagccgttccatatgcgcccttcatctcggcgacgtgctctacttttgacagctcaggcacaagcatcgcccggtacggctgatggaacatatccttcttcatgattttcccgacaagcggccaatccttggacatgatcgcagcaatgaggatattgctgacagcacttgcttttacggcatcggcatatggaaactccttcggaagcacgtctctcgcgtctcttgtcagcacttcataaaaaggaatgacaacgactacgtcaatgtcagcattcgggacgcggatcatttgggtctcgtcatcctcatgcaggccgatcacaagtccgccgacgagagaagcgccagcattgtccgggtgtccttcttctagactcgctaaatgcagcttgtccgcttcagacagctttaagccgcataattcatcagccagttcaatggccgctacaatcgctgcggcgctgctgccaaggccgcgtgcaagcgggatgtcgctccacaccttcacatggacaggaggcatttcttttccgtacaaatctgcggtccgtttagccacttggtagatcaggttatctgtacccgccggaattccggcgactgtttctgtttcagcctcaaaagaccatttgtcgctttcaaagacggtcagcttcaaatatctgctgagcgccattccgactgaatcaaagccggggcctaggttagctgtgcttccgggaacagtgacagagaacagcatgtcggcttcgttcat

SEQ ID NO: 136 - protein, 316 aa, Pseudomonas putida
  MISC_FEATURE: homoserine kinase
MSVFTPVTRPELETFLAPYELGRLLDFQGIAAGTENSNFFVSLEQGEFVLTLIERGPSEDMPFFIELLDTLHGADMPVPYAIRDRDGNGLRELCGKPALLQPRLSGKHIKAPNNQHCAQVGELLAHIHLATREHIIERRTDRGLDWMLASGVELLPRLTAEQAALLQPALDEISAHKAQILALPRANLHADLFRDNVMFEGTHLTGVIDFYNACSGPMLYDIAITVNDWCLDEQGAVDVPRAQALLAAYAALRPFTAAEAELWPEMLRVGCVRFWLSRLIAAESFAGMDVMIHDPSEFEVRLAQRQQVALHLPFAL

SEQ ID NO: 137 - DNA, 951 bp, Pseudomonas putida
  misc_feature: Encodes homoserine kinase
ctacagcgcgaacggcaggtgcaaagccacctgctggcgctgcgccagacgtacttcaaactcgctcggatcgtggatcatcacatccatcccggcaaacgattcggcggcaatcaggcgcgacagccagaaacgcacgcagcctaccctcaacatttccggccacagctcggcttcggctgcagtgaacggccgtagcgccgcataggctgccagcagcgcctgggcgcgtggtacatccaccgctccctgctcatccaggcaccagtcgttcacggtgatggcaatgtcatacagcatcggcccggagcaggcattgtagaagtcgatcacaccggtcaggtgggtgccttcgaacatcacgttgtcgcggaacaggtcggcatgcaggttggcccgcggcaaggccaggatctgcgccttatgtgcgctgatttcgtccagcgccggctgcagcaatgcggcttgctccgcagtcaggcgtggcagtagctcgacacccgaggccagcatccagtccaggccgcggtcggtgcggcgctcgatgatgtgctctcgggtggccaggtgaatgtgtgccagtagctcgccgacctgggcgcagtgctggttgttgggtgccttgatgtgtttgcccgacagcctgggctgcagcaatgccggcttgccgcacagctcgcgcaggccgttgccgtcgcgatcacgaatggcatagggcaccggcatgtcggcaccgtgcagggtatcgagcagctcgatgaagaacggcatgtcctcgctgggcccacgctcgatcagcgtcaggacgaactccccctgttcgaggctgacgaagaaattgctgttctcggtaccggcggcaatgccctggaagtcgagcagacggcccagctcgtacggcgccagaaaggtttccagctcaggccgggtcacgggggtgaagactgacat

SEQ ID NO: 138 - protein, 357 aa, Saccharomyces cerevisiae
  MISC_FEATURE: homoserine kinase
MVRAFKIKVPASSANIGPGYDVLGVGLSLFLELDVTIDSSQAQETNDDPNNCKLSYTKESEGYSTVPLRSDANLITRTALYVLRCNNIRNFPSGTKVHVSNPIPLGRGLGSSGAAVVAGVILGNEVAQLGFSKQRMLDYCLMIERHPDNITAAMMGGFCGSFLRDLTPQEVERREIPLAEVLPEPSGGEDTGLVPPLPPTDIGRHVKYQWNPAIKCIAIIPQFELSTADSRGVLPKAYPTQDLVFNLQRLAVLTTALTMDPPNADLIYPAMQDRVHQPYRKTLIPGLTEILSCVTPSTYPGLLGICLSGAGPTILALATENFEEISQEIINRFAKNGIKCSWKLLEPAYDGASVEQQ

SEQ ID NO: 139 - DNA, 1074 bp, Saccharomyces cerevisiae
  misc_feature: Encodes homoserine kinase
atggttcgtgccttcaaaattaaagttccagcttcttccgccaatatcggccctggttatgatgttcttggtgtcggtctttctctattcttggagttagatgtcaccatcgactccagccaagctcaggaaacaaacgacgatcccaacaactgcaagctgtcttacactaaagaaagtgaaggctattctacggtcccattgcgttctgatgctaacctgattaccaggactgcgttatatgtgttgcgttgcaacaatattagaaacttcccctccggaaccaaagttcacgtctccaacccaatcccacttggccgtggattgggttcctctggtgcagcagttgtggcaggtgttattttaggtaacgaagtggcccaattgggtttctctaagcaacgtatgttggactactgtttgatgattgaacgtcatccagacaacataaccgctgctatgatgggaggcttttgcggttcattcctaagggacttgaccccacaagaggtggaaagacgtgagattccattggctgaggtgcttccagaaccttctggtggtgaagataccggtctggttcccccattacctcccaccgatatcggtagacatgtcaaataccaatggaaccccgccattaaatgtattgcgatcatcccacagttcgagttgtccaccgccgactccagaggcgttcttccaaaagcctacccaacccaggacttggttttcaatctacaaagattggccgtcttgaccacagctttgaccatggacccacctaatgccgacttaatctaccctgctatgcaagatcgtgtccaccaaccttatagaaagacattgatcccaggtctcacggaaatcttatcatgtgtcaccccatccacataccctggcctattgggtatctgcttgtcaggtgcaggcccaactatcttggctttggccactgagaatttcgaagaaatctctcaagaaattatcaacaggttcgccaaaaacggcatcaagtgctcctggaaactactggagcctgcctacgatggtgctagcgtcgaacagcaatga

SEQ ID NO: 140 - protein, 428 aa, Escherichia coli
  MISC_FEATURE: threonine synthase
MKLYNLKDHNEQVSFAQAVTQGLGKNQGLFFPHDLPEFSLTEIDEMLKLDFVTRSAKILSAFIGDEIPQEILEERVRAAFAFPAPVANVESDVGCLELFHGPTLAFKDFGGRFMAQMLTHIAGDKPVTILTATSGDTGAAVAHAFYGLPNVKVVILYPRGKISPLQEKLFCTLGGNIETVAIDGDFDACQALVKQAFDDEELKVALGLNSANSINISRLLAQICYYFEAVAQLPQETRNQLVVSVPSGNFGDLTAGLLAKSLGLPVKRFIAATNVNDTVPRFLHDGQWSPKATQATLSNAMDVSQPNNWPRVEELFRRKIWQLKELGYAAVDDETTQQTMRELKELGYTSEPHAAVAYRALRDQLNPGEYGLFLGTAHPAKFKESVEAILGETLDLPKELAERADLPLLSHNLPADFAALRKLMMNHQ

SEQ ID NO: 141 - DNA, 1287 bp, Escherichia coli
  misc_feature: Encodes threonine synthase
atgaaactctacaatctgaaagatcacaacgagcaggtcagctttgcgcaagccgtaacccaggggttgggcaaaaatcaggggctgttttttccgcacgacctgccggaattcagcctgactgaaattgatgagatgctgaagctggattttgtcacccgcagtgcgaagatcctctcggcgtttattggtgatgaaatcccacaggaaatcctggaagagcgcgtgcgcgcggcgtttgccttcccggctccggtcgccaatgttgaaagcgatgtcggttgtctggaattgttccacgggccaacgctggcatttaaagatttcggcggtcgctttatggcacaaatgctgacccatattgcgggtgataagccagtgaccattctgaccgcgacctccggtgataccggagcggcagtggctcatgctttctacggtttaccgaatgtgaaagtggttatcctctatccacgaggcaaaatcagtccactgcaagaaaaactgttctgtacattgggcggcaatatcgaaactgttgccatcgacggcgatttcgatgcctgtcaggcgctggtgaagcaggcgtttgatgatgaagaactgaaagtggcgctagggttaaactcggctaactcgattaacatcagccgtttgctggcgcagatttgctactactttgaagctgttgcgcagctgccgcaggagacgcgcaaccagctggttgtctcggtgccaagcggaaacttcggcgatttgacggcgggtctgctggcgaagtcactcggtctgccggtgaaacgttttattgctgcgaccaacgtgaacgataccgtgccacgtttcctgcacgacggtcagtggtcacccaaagcgactcaggcgacgttatccaacgcgatggacgtgagtcagccgaacaactggccgcgtgtggaagagttgttccgccgcaaaatctggcaactgaaagagctgggttatgcagccgtggatgatgaaaccacgcaacagacaatgcgtgagttaaaagaactgggctacacttcggagccgcacgctgccgtagcttatcgtgcgctgcgtgatcagttgaatccaggcgaatatggcttgttcctcggcaccgcgcatccggcgaaatttaaagagagcgtggaagcgattctcggtgaaacgttggatctgccaaaagagctggcagaacgtgctgatttacccttgctttcacataatctgcccgccgattttgctgcgttgcgtaaattgatgatgaatcatcagtaa

SEQ ID NO: 142 - protein, 352 aa, Bacillus subtilis
  MISC_FEATURE: threonine synthase
MWKGLIHQYKEFLPVTDQTPALTLHEGNTPLIHLPKLSEQLGIELHVKTEGVNPTGSFKDRGMVMAVAKAKEEGNDTIMCASTGNTSAAAAAYAARANMKCIVIIPNGKIAFGKLAQAVMYGAEIIAIDGNFDDALKIVRSICEKSPIALVNSVNPYRIEGQKTAAFEVCEQLGEAPDVLAIPVGNAGNITAYWKGFKEYHEKNGTGLPKMRGFEAEGAAAIVRNEVIENPETIATAIRIGNPASWDKAVKAAEESNGKIDEVTDDEILHAYQLIARVEGVFAEPGSCASIAGVLKQVKSGEIPKGSKVVAVLTGNGLKDPNTAVDISEIKPVTLPTDEDSILEYVKGAARV

SEQ ID NO: 143 - DNA, 1059 bp, Bacillus subtilis
  misc_feature: Encodes threonine synthase
tcatacacgggccgctccttttacatattcaaggatgctgtcttcatcagtcggcaatgtgacaggcttgatttctgaaatgtcgaccgctgtgttcggatctttcagtccgtttcctgttaacacagctacgaccttgctgcctttcggaatttctccggatttcacctgtttcagcactcctgcgatagacgcgcaagaacctggttctgcaaacacgccttctacacgggcgatcagctgatatgcgtgaaggatttcatcatcagtgacttcgtcaattttcccattggattcctcggctgcctttacagctttgtcccagcttgccgggtttccgatacgaatggctgtcgctattgtttccggattttcaatcacttcattgcgcacgattgccgccgcaccctcagcttcaaagccgcgcattttcggaaggcctgtgccgtttttctcatgatattccttgaagcccttccagtacgcagtgatgtttccagcatttccgaccgggatcgctaaaacatcaggcgcttcccccagctgttcgcacacttcgaaggcagcagttttttggccttcaatgcggtaagggttgactgagttgacaagggcaatcggtgatttctcacagatggaacggacaattttaagcgcatcgtcaaagtttccgtcaattgcgataatctcggctccgtacatgacagcttgagcgagttttccaaatgcaatttttccgttcgggatgatgacaatgcatttcatgttagcacgggctgcatatgctgccgcagcagcggaagtgttacctgttgacgcgcacataatcgtgtcattgccttcttcttttgcctttgccacagccataaccattccgcgatctttaaatgatcccgtaggattgacgccttccgttttgacatgaagctcaattccgagctgctcagacagcttcggcaggtgaataagaggtgtgtttccttcatgtaaagttagcgccggtgtttgatctgttacaggtaaaaattctttatattgatggataagtcctttccacat

SEQ ID NO: 144 - protein, 481 aa, Corynebacterium glutamicum
  MISC_FEATURE: threonine synthase
MDYISTRDASRTPARFSDILLGGLAPDGGLYLPATYPQLDDAQLSKWREVLANEGYAALAAEVISLFVDDIPVEDIKAITARAYTYPKFNSEDIVPVTELEDNIYLGHLSEGPTAAFKDMAMQLLGELFEYELRRRNETINILGATSGDTGSSAEYAMRGREGIRVFMLTPAGRMTPFQQAQMFGLDDPNIFNIALDGVFDDCQDVVKAVSADAEFKKDNRIGAVNSINWARLMAQVVYYVSSWIRTTTSNDQKVSFSVPTGNFGDICAGHIARQMGLPIDRLIVATNENDVLDEFFRTGDYRVRSSADTHETSSPSMDISRASNFERFIFDLLGRDATRVNDLFGTQVRQGGFSLADDANFEKAAAEYGFASGRSTHADRVATIADVHSRLDVLIDPHTADGVHVARQWRDEVNTPIIVLETALPVKFADTIVEAIGEAPQTPERFAAIMDAPFKVSDLPNDTDAVKQYIVDAIANTSVK

SEQ ID NO: 145 - DNA, 1446 bp, Corynebacterium glutamicum
  misc_feature: Encodes threonine synthase
ttacttcacggaagtgtttgcaatcgcatcgactatgtactgcttaactgcatcggtgtcgtttggtaggtcggaaaccttgaatggagcatccatgatcgcggcgaaacgctctggagtttgaggtgcttcaccaattgcttcgacgatggtgtcggcaaatttcactgggagtgcagtttctaggacgatgattggggtgttgacctcgtccctccactggcgtgccacgtgaacgccgtcggcggtgtggggatcgattagtacgtcgaggcgggaatgcacgtcagcgatggttgccacacggtcagcatgggtggatcgtccggaggcgaaaccgtattctgctgcagccttctcaaagttggcgtcatcagccagtgagaatccgccttggcgaacctgggtaccaaatagatcgttgacgcgggtggcgtcgcggccgagcaggtcgaagatgaaacgctcgaagttggaggcgcgggagatatccatcgaaggtgaggaggtctcgtgggtgtctgcggagctgcggactcggtagtcgccggtacggaagaactcgtcgagcacatcgttttcgttggtggccacgatgaggcgatcgatgggaagtcccatttggcgggcgatgtggcctgcgcaaatgtcaccgaagttgccggttggtacggagaagctgaccttttggtcattgctggttgtggtgcggatccatgaggaaacgtagtacacaacctgtgccataaggcgtgcccagttgatggagttcacggcaccgatgcggttgtcttttttgaattctgcgtcggcggagacagccttgactacgtcttggcaatcgtcgaaaacgccgtcgagggcgatgttgaagatgtttggatcgtcaaggccaaacatctgtgcttgctggaatggggtcatgcggccagctggggtcagcatgaatacgcggattccctcgcggccgcgcatggcgtattccgcagaggagccggtatcgccagaggtagcgcccaggatgttgatggtttcgttgcggcggcgaagctcgtattcgaaaagttcgccgagcagctgcatggccatgtctttgaatgcagcggttgggccttcggaaaggtggcccaggtaaatgttgtcctcgagttcggtgacaggaacgatgtcttcgctgttgaacttcgggtaggtgtaggcgcgtgcggtgatcgccttgatgtcttctactgggatgtcatcaacaaacagggagataacttcagcagccaaagctgcgtatccttcgttggctaatacctcacgccatttactcagctgggcatcatctagttgagggtaggttgcaggcaggtacaggccgccgtctggtgctagaccgcccagcaaaatatcactgaagcgggcaggggtacggctggcatcacgcgtcgaaatgtagtccac

SEQ ID NO: 146 - protein, 329 aa, Escherichia coli
  MISC_FEATURE: threonine deaminase (TdcB)
MHITYDLPVAIDDIIEAKQRLAGRIYKTGMPRSNYFSERCKGEIFLKFENMQRTGSFKIRGAFNKLSSLTDAEKRKGVVACSAGNHAQGVSLSCAMLGIDGKVVMPKGAPKSKVAATCDYSAEVVLHGDNFNDTIAKVSEIVEMEGRIFIPPYDDPKVIAGQGTIGLEIMEDLYDVDNVIVPIGGGGLIAGIAVAIKSINPTIRVIGVQSENVHGMAASFHSGEITTHRTTGTLADGCDVSRPGNLTYEIVRELVDDIVLVSEDEIRNSMIALIQRNKVVTEGAGALACAALLSGKLDQYIQNRKTVSIISGGNIDLSRVSQITGFVDA

SEQ ID NO: 147 - DNA, 990 bp, Escherichia coli
  misc_feature: Encodes threonine deaminase (TdcB)
ttaagcgtcaacgaaaccggtgatttgagagacgcgagaaagatcgatattgccgccggaaataatactgacggtttttctgttttgaatatattggtctaatttaccgcttaataatgcagcacatgccagagcgcctgcgccttcggtgacgactttattgcgctgaattaaggcaatcatactgtttctgatttcgtcttcgctgaccagcacgatgtcatcgactaattcacgaacgatttcgtaagttaaattacccgggcgggagacatcacaaccatccgccagggtgccggtagttcggtgcgtggttatttctccggagtggaaagaagccgccatgccgtgaacgttttcagactgtacgccaataacacgaatggtcgggttaatagatttaattgccaccgcaataccagcaattaaaccgccaccaccaattggcacaatcacgttatcgacatcatagagatcttccataatttccagaccaatcgttccctggccagcaatcactttcggatcatcgtaaggtgggataaaaatacggccttccatttcgacaatttcgctcactttagcgatagtgtcgttgaagttatcaccatgcagaacgacttctgcggagtagtcgcacgttgccgctactttggattttggcgcaccttttggcatcaccactttaccgtcgatacccagcatcgcgcaggagagggaaaccccttgcgcatggttgcccgcagaacaggccaccacgcctttgcgtttttccgcatcggtcagtgaacttaatttattaaatgcgccacgaattttaaatgaacccgtacgctgcatattttcaaacttcaggaatatttcacctttgcaacgttcactaaaatagttggagcgaggcatgcctgttttataaattcgcccagccagtcgttgtttcgcttcaataatgtcatcaatagcaaccggcagatcgtatgtaatatgcat

SEQ ID NO: 148 - protein, 514 aa, Escherichia coli [sequence omitted]

SEQ ID NO: 149 - DNA, 1545 bp, Escherichia coli
  misc_feature: Encodes threonine deaminase (ilvA)
atggctgactcgcaacccctgtccggtgctccggaaggtgccgaatatttaagagcagtgctgcgcgcgccggtttacgaggcggcgcaggttacgccgctacaaaaaatggaaaaactgtcgtcgcgtcttgataacgtcattctggtgaagcgcgaagatcgccagccagtgcacagctttaagctgcgcggcgcatacgccatgatggcgggcctgacggaagaacagaaagcgcacggcgtgatcactgcttctgcgggtaaccacgcgcagggcgtcgcgttttcttctgcgcggttaggcgtgaaggccctgatcgttatgccaaccgccaccgccgacatcaaagtcgacgcggtgcgcggcttcggcggcgaagtgctgctccacggcgcgaactttgatgaagcgaaagccaaagcgatcgaactgtcacagcagcaggggttcacctgggtgccgccgttcgaccatccgatggtgattgccgggcaaggcacgctggcgctggaactgctccagcaggacgcccatctcgaccgcgtatttgtgccagtcggcggcggcggtctggctgctggcgtggcggtgctgatcaaacaactgatgccgcaaatcaaagtgatcgccgtagaagcggaagactccgcctgcctgaaagcagcgctggatgcgggtcatccggttgatctgccgcgcgtagggctatttgctgaaggcgtagcggtaaaacgcatcggtgacgaaaccttccgtttatgccaggagtatctcgacgacatcatcaccgtcgatagcgatgcgatctgtgcggcgatgaaggatttattcgaagatgtgcgcgcggtggcggaaccctctggcgcgctggcgctggcgggaatgaaaaaatatatcgccctgcacaacattcgcggcgaacggctggcgcatattctttccggtgccaacgtgaacttccacggcctgcgctacgtctcagaacgctgcgaactgggcgaacagcgtgaagcgttgttggcggtgaccattccggaagaaaaaggcagcttcctcaaattctgccaactgcttggcgggcgttcggtcaccgagttcaactaccgttttgccgatgccaaaaacgcctgcatctttgtcggtgtgcgcctgagccgcggcctcgaagagcgcaaagaaattttgcagatgctcaacgacggcggctacagcgtggttgatctctccgacgacgaaatggcgaagctacacgtgcgctatatggtcggcggacgtccatcgcatccgttgcaggaacgcctctacagcttcgaattcccggaatcaccgggcgcgctgctgcgcttcctcaacacgctgggtacgtactggaacatttctttgttccactatcgcagccatggcaccgactacgggcgcgtactggcggcgttcgaacttggcgaccatgaaccggatttcgaaacccggctgaatgagctgggctacgattgccacgacgaaaccaataacccggcgttcaggttctttttggcgggttag

SEQ ID NO: 150 - protein, 422 aa, Bacillus subtilis
  MISC_FEATURE: threonine deaminase (IlvA)
MKPLLKENSLIQVKDILKAHQNVKDVVIHTPLQRNDRLSERYECNIYLKREDLQVVRSFKLRGAYHKMKQLSSEQTENGVVCASAGNHAQGVAFSCKHLGIHGKIFMPSTTPRQKVSQVELFGKGFIDIILTGDTFDDAYKSAAECCEAESRTFIHPFDDPDVMAGQGTLAVEILNDIDTEPHFLFASVGGGGLLSGVGTYLKNVSPDTKVIAVEPAGAASYFESNKAGHVVTLDKIDKFVDGAAVKKIGEETFRTLETVVDDILLVPEGKVCTSILELYNECAVVAEPAGALSVAALDLYKDQIKGKNVVCVVSGGNNDIGRMQEMKERSLIFEGLQHYFIVNFPQRAGALREFLDEVLGPNDDITRFEYTKKNNKSNGPALVGIELQNKADYGPLIERMNKKPFHYVEVNKDEDLFHLLI

SEQ ID NO: 151 - DNA, 1269 bp, Bacillus subtilis
  misc_feature: Encodes threonine deaminase (IlvA)
ttagattagcaaatggaacaagtcctcatccttgttcacctctacataatgaaacggttttttgttcatccgttcaatcagcggcccataatcggctttgttctgcagctcgatgccgacaagagcaggtccattgcttttattatttttcttcgtatattcaaaccttgtaatgtcatcattcggcccgaggacttcgtcaagaaattcgcggagcgcccccgctctttgtggaaaattgacgataaaataatgctgaaggccttcaaaaatcaaggaacgctccttcatttcctgcattcttccgatatcgttattgcccccgcttaccacacacaccacgtttttccctttaatttgatccttgtacaaatcaagcgctgcgacagaaagagctccagccggttcagcaacaaccgcacattcgttatataattcaagaatggatgtacatacttttccttcaggcacaaggagaatgtcatcaacgacagtttccagcgtccggaaggtttcctcgccaatttttttaacagccgccccatctacaaacttatcaattttatcaagtgtgacgacatgcccagctttgtttgattcaaagtaggatgccgctcccgccggctcaacagcaattacctttgtatcaggagacacgtttttcaaatatgtacctaccccagagagaaggccgccgcctccgacacttgcaaaaagaaaatgcggttctgtatcaatgtcgtttaaaatctcgactgcgagcgttccctgtccggccatcacatccggatcatcgaacggatggataaacgtccgagattccgcctcacagcattcagcagcgcttttatacgcgtcgtcaaacgtatcgcctgtcaaaataatatcgataaatccttttccgaatagttcaacttgagatactttttgtctcggtgtagtagacggcataaaaattttcccgtgaatgccaagatgtttacacgaaaatgccacaccttgagcgtggtttccggcacttgcacacacaactccgttctctgtctgctcgctggaaagctgtttcattttatgataagcccctctgagcttaaaagatctgacaacttgcaagtcttcgcgttttaaatagatattgcattcatatctctcagaaagtctgtcattcctctgcaaaggtgtgtgaatgacaacgtcctttacgttttggtgagccttcaaaatgtctttcacttggatgagagagttttctttaagcaacggtttcat

SEQ ID NO: 152 - protein, 436 aa, Corynebacterium glutamicum
  MISC_FEATURE: threonine deaminase (IlvA)
MSETYVSEKSPGVMASGAELIRAADIQTAQARISSVIAPTPLQYCPRLSEETGAEIYLKREDLQDVRSYKIRGALNSGAQLTQEQRDAGIVAASAGNHAQGVAYVCKSLGVQGRIYVPVQTPKQKRDRIMVHGGEFVSLVVTGNNFDEASAAAHEDAERTGATLIEPFDARNTVIGQGTVAAEILSQLTSMGKSADHVMVPVGGGGLLAGVVSYMADMAPRTAIVGIEPAGAASMQAALHNGGPITLETVDPFVDGAAVKRVGDLNYTIVEKNQGRVHMMSATEGAVCTEMLDLYQNEGIIAEPAGALSIAGLKEMSFAPGSVVVCIISGGNNDVLRYAEIAERSLVHRGLKHYFLVNFPQKPGQLRHFLEDILGPDDDITLFEYLKRNNRETGTALVGIHLSEASGLDSLLERMEESAIDSRRLEPGTPEYEYLT

SEQ ID NO: 153 - DNA, 1311 bp, Corynebacterium glutamicum
  misc_feature: Encodes threonine deaminase (IlvA)
ttaggtcaagtattcgtactcaggggtgcccggctcgaggcgacgggaatcaattgccgattcctccatacgttccagcaaagaatccaatcctgatgcttcactcaagtgaatacccaccaacgcagtaccggtctcacggttgttgcgcttgaggtactcaaacagcgtgatgtcatcatccggtcccaggatatcttccaggaagtgacgcaactgaccaggcttttgcgggaagttcaccaagaagtagtgcttcaaaccgcggtgcaccaaggagcgctcagcgatttccgcataacgcagcacatcgttgttgccaccagagatgatgcacaccacgacagaaccaggtgcaaaggacatttccttcaacccagcgatagacagcgcgccagcaggctccgcgatgatgccttcgttttggtaaagatcgagcatctcagtacacacagcgccctcggtcgcgctcatcatgtgcacgcgaccctggttcttctccacgatggtgtagttgagatctccgacacgtttgactgctgcgccgtccacaaagggatcaacagtctccaaagtgattggtccaccattgtgcaatgcagcctgcatggatgctgctcccgctggttcgataccaacgatcgcagtgcgaggtgccatatcagccatgtagctgaccacacctgcaagaagtccgccaccgccgactggaaccatcacgtgatctgcactcttgcccatggaagtcagctgcgacaagatctcagcagccacggtgccctgaccgatgacggtgttgcgagcatcgaaaggctcgatcagcgttgcgccggtgcgctctgcatcttcatgcgctgcagccgatgcttcgtcgaagttattgccagtgaccaccaaggagacaaactctccgccgtgaaccatgatgcggtcacgcttttgctttggagtctgcacaggaacatagatgcgtccctgaacgcccaaggacttgcacacataggccacgccctgggcatggttacctgcagatgcggcaacgatacctgcatcgcgctgctcttgggtgagctgcgctccagagttcagcgcaccgcggatcttgtaggaacgaacatcctgcagatcctcacgcttaaggtagatttccgctccggtttcctcagaaagacgagggcaatactgcaatggagttggtgcaatgacggaggaaattcgtgcctgcgccgtttgaatgtcggcggcacgaatcagctccgctccgctagccatcactcctggacttttctcagacacgtatgtttcactcat

SEQ ID NO: 154 - protein, 310 aa, Corynebacterium glutamicum
  MISC_FEATURE: threonine deaminase (TdcB)
MLTLNDVITAQQRTAPHVRRTPLFEADPIDGTQIWIKAEFLQKCGVFKTRGAFNRQLAASENGLLDPTVGIVAASGGNAGLANAFAAASLSVPATVLVPETAPQVKVDRLKQYGATVQQIGSEYAEAFEAAQTFESETGALFCHAYDQPDIAAGAGVIGLEIVEDLPDVDTIVVAVGGGGLYAGIAAVVAAHDIKVVAVEPSKIPTLHNSLIAGQPVDVNVSGIAADSLGARQIGREAFDIATAHPPIGVLVDDEAIIAARRHLWDNYRIPAEHGAAAALASLTSGAYKPAADEKVAVIVCGANTDLTTL

SEQ ID NO: 155 - DNA, 933 bp, Corynebacterium glutamicum
  misc_feature: Encodes threonine deaminase (TdcB)
tcacagtgttgtgaggtcagtgttcgctccgcacacaatgactgccactttttcatctgctgcaggtttgtatgctccactggtaagagaggcgagtgctgcggcagcgccatgctcggcagggatgcggtagttgtcccagaggtggcgtcgagctgcgatgattgcttcatcgtccactaggacgcctattgggggatgggcagttgcgatgtcaaaggcttctcgtccaatttggcgagcccccaaagaatctgccgcgataccagaaacgttcacatcgactggttggccggcaatgagtgagttgtgcagggttggaattttggagggttcaacggccaccactttgatgtcgtgggctgctacgacggctgcgattcctgcatagagtccaccgccaccgacagcaaccacgatggtgtcaacgtcgggaagatcttcgacaatttctagcccaatgacgcctgctccagctgcgatgtcgggctggtcgtaggcgtggcaaaacagagcaccagtttccgactcaaaggtttgagctgcctcaaatgcttccgcatattcagatccgatttgttgcacggttgcaccgtattgcttgaggcgatcaacttttacttgtggggcagtttcgggcaccaataccgtggcgggaacgcttaaggatgctgcggcaaaagcatttgcgagtcctgcgtttccgcctgatgccgcgacgatgccaaccgttgggtcgagtagtccgttttccgaagctgcgagctggcggttgaatgctccacgcgttttgaacacgccgcacttttggaggaactctgctttgatccagatttgtgtgccgtcgatggggtctgcttcgaaaagtggcgttcgtcgaacatgaggggcggttcgttgttgggcggtgatgacatcgttgagggtgagcat

SEQ ID NO: 156 - protein, 491 aa, Methanocaldococcus jannaschii
  MISC_FEATURE: (R)-citramalate synthase
MMVRIFDTTLRDGEQTPGVSLTPNDKLEIAKKLDELGVDVIEAGSAITSKGEREGIKLITKEGLNAEICSFVRALPVDIDAALECDVDSVHLVVPTSPIHMKYKLRKTEDEVLETALKAVEYAKEHGLIVELSAEDATRSDVNFLIKLFNEGEKVGADRVCVCDTVGVLTPQKSQELFKKITENVNLPVSVHCHNDFGMATANTCSAVLGGAVQCHVTVNGIGERAGNASLEEVVAALKILYGYDTKIKMEKLYEVSRIVSRLMKLPVPPNKAIVGDNAFAHEAGIHVDGLIKNTETYEPIKPEMVGNRRRIILGKHSGRKALKYKLDLMGINVSDEQLNKIYERVKEFGDLGKYISDADLLAIVREVTGKLVEEKIKLDELTVVSGNKITPIASVKLHYKGEDITLIETAYGVGPVDAAINAVRKAISGVADIKLVEYRVEAIGGGTDALIEVVVKLRKGTEIVEVRKSDADIIRASVDAVMEGINMLLN

SEQ ID NO: 157 - DNA, 1476 bp, Methanocaldococcus jannaschii
  misc_feature: Encodes (R)-citramalate synthase
atgatggtaaggatatttgatacaacacttagagatggagagcaaacaccaggagtttctttaacaccaaatgataagttagagatagcaaaaaaattggatgagcttggagttgatgttatagaggcaggttcagctataacttcaaaaggagagagagaaggaataaaattaataacaaaagaaggtttaaatgcagaaatctgctcatttgttagagctttacctgtagatattgatgctgccttagaatgtgatgtagatagtgtccatttagtagtgccaacatctccaatacacatgaaatataagcttagaaaaacagaagatgaggttttagagacagctttaaaggctgtagagtatgctaaagaacatggattgattgttgagttatctgcagaggatgcaacaagaagtgatgtaaatttcttaataaaactatttaatgaaggggaaaaggttggagcagacagagtttgtgtttgtgacacagtaggagttttaactccacaaaagagtcaggaattatttaaaaaaataactgaaaatgttaatttaccggtctcagttcattgccacaacgactttggaatggctactgctaatacttgctcagcagttttaggtggagctgttcagtgccacgtaacagttaatggtattggagagagagcaggaaatgcctcattggaagaggttgttgctgctttaaaaatactctatggctatgatactaagataaagatggaaaagttatatgaggtttcaagaattgtctcaagattgatgaaacttcctgttccaccaaataaagcaattgttggggacaatgcatttgctcatgaagcaggaatacatgttgatggattaataaaaaatactgaaacctatgagccaataaaaccagaaatggttgggaatagaagaagaattattttgggtaagcattctggtagaaaagctttaaaatacaaacttgatttgatgggcataaacgttagtgatgagcaattaaataaaatatatgaaagagttaaagaatttggggatttgggtaaatacatttcagacgctgatttgttggctatagttagagaagttactggaaaattggtagaagagaaaatcaaattagatgaattaactgttgtatctggaaataaaataacaccaattgcatctgttaaactccattataaaggagaagatataactttaatagaaactgcttatggtgttggaccggtagatgcagcaataaatgctgtgagaaaggcaataagtggagttgcagatattaagttggtagagtatagagttgaagcaattggtggaggaactgatgcgttaatagaggttgttgttaaattaagaaaaggaactgaaattgttgaagttagaaaatcagacgctgatataataagggcttctgtagatgctgtaatggaaggaatcaatatgttattgaattaa

SEQ ID NO: 158 - protein, 372 aa, Methanocaldococcus jannaschii variant
  MISC_FEATURE: Methanocaldococcus jannaschii  (R)-citramalate synthase variant
MMVRIFDTTLRDGEQTPGVSLTPNDKLEIAKKLDELGVDVIEAGSAVTSKGEREGIKLITKEGLNAEICSFVRALPVDIDAALECDVDSVHLVVPTSPIHMKYKLRKTEDEVLVTALKAVEYAKEQGLIVELSAEDATRSDVNFLIKLFNEGEKVGADRVCVCDTVGVLTPQKSQELFKKITENVNLPVSVHCHNDFGMATANACSAVLGGAVQCHVTVNGIGERAGNASLEEVVAASKILYGYDTKIKMEKLYEVSRIVSRLMKLPVPPNKAIVGDNAFAHEAGIHVDGLIKNTETYEPIKPEMVGNRRRIILGKHSGRKALKYKLDLMGINVSDEQLNKIYERVKEFGDLGKYISDADLLAIVREVTGKL

SEQ ID NO: 159 - DNA, 1119 bp, Methanocaldococcus jannaschii variant
  misc_feature: Encodes Methanocaldococcus jannaschii  (R)-citramalate synthase variant
atgatggtaaggatatttgatacaacacttagagatggagagcaaacaccaggagtttctttaacaccaaatgataagttagagatagcaaaaaaattggatgagcttggagttgatgttatagaggcaggttcagctgtaacttcaaaaggagagagagaaggaataaaattaataacaaaagaaggtttaaatgcagaaatctgctcatttgttagagctttacctgtagatattgatgctgccttagaatgtgatgtagatagtgtccatttagtagtgccaacatctccaatacacatgaaatataagcttagaaaaacagaagatgaggttttagtgacagctttaaaggctgtagagtatgctaaagaacagggattgattgttgagttatctgcagaggatgcaacaagaagtgatgtaaatttcttaataaaactatttaatgaaggggaaaaggttggagcagacagagtttgtgtttgtgacacagtaggagttttaactccacaaaagagtcaggaattatttaaaaaaataactgaaaatgttaatttaccggtctcagttcattgccacaacgactttggaatggctactgctaatgcttgctcagcagttttaggtggagctgttcagtgccacgtaacagttaatggtattggagagagagcaggaaatgcctcattggaagaggttgttgctgcttcaaaaatactctatggctatgatactaagataaagatggaaaagttatatgaggtttcaagaattgtctcaagattgatgaaacttcctgttccaccaaataaagcaattgttggggacaatgcatttgctcatgaagcaggaatacatgttgatggattaataaaaaatactgaaacctatgagccaataaaaccagaaatggttgggaatagaagaagaattattttgggtaagcattctggtagaaaagctttaaaatacaaacttgatttgatgggcataaacgttagtgatgagcaattaaataaaatatatgaaagagttaaagaatttggggatttgggtaaatacatttcagacgctgatttgttggctatagttagagaagttactggaaaattgtaa

SEQ ID NO: 160 - protein, 516 aa, Leptospira interrogans
  MISC_FEATURE: (R)-citramalate synthase
MTKVETRLEILDVTLRDGEQTRGVSFSTSEKLNIAKFLLQKLNVDRVEIASARVSKGELETVQKIMEWAATEQLTERIEILGFVDGNKTVDWIKDSGAKVLNLLTKGSLHHLEKQLGKTPKEFFTDVSFVIEYAIKSGLKINVYLEDWSNGFRNSPDYVKSLVEHLSKEHIERIFLPDTLGVLSPEETFQGVDSLIQKYPDIHFEFHGHNDYDLSVANSLQAIRAGVKGLHASINGLGERAGNTPLEALVTTIHDKSNSKTNINEIAITEASRLVEVFSGKRISANRPIVGEDVFTQTAGVHADGDKKGNLYANPILPERFGRKRSYALGKLAGKASISENVKQLGMVLSEVVLQKVLERVIELGDQNKLVTPEDLPFIIADVSGRTGEKVLTIKSCNIHSGIGIRPHAQIELEYQGKIHKEISEGDGGYDAFMNALTKITNRLGISIPKLIDYEVRIPPGGKTDALVETRITWNKSLDLEEDQTFKTMGVHPDQTVAAVHATEKMLNQILQPWQI

SEQ ID NO: 161 - DNA, 1551 bp, Leptospira interrogans
  misc_feature: Encodes (R)-citramalate synthase
atgacaaaagtagaaactcgattggaaattttagacgtaactttgagagacggggagcagaccagaggggtcagtttttccacttccgaaaaactaaatatcgcaaaatttctattacaaaaactaaatgtagatcgggtagagattgcgtctgcaagagtttctaaaggggaattggaaacggtccaaaaaatcatggaatgggctgcaacagaacagcttacggaaagaatcgaaatcttaggttttgtagacgggaataaaaccgtagattggatcaaagatagtggggctaaggttttaaatcttttgactaagggatcgcttcatcatttagaaaaacaattaggcaaaactccgaaagaattctttacagacgtttcttttgtaatagaatacgcgatcaaaagcggacttaaaataaacgtatatttagaagattggtccaacggtttcagaaacagtccagattacgtcaaatcgctcgtagaacatctaagtaaagaacatatagaaagaatttttcttccagacacgttaggcgttctttcgccagaagagacgtttcaaggagtggattcactcattcaaaaatacccggatattcattttgaatttcacggacataacgactacgatctttccgtggcaaatagtcttcaagcgattcgtgccggagtcaaaggtcttcacgcttctataaatggtctcggagaaagagccggaaatactccgttggaagcactcgtaaccacgattcatgataagtctaactctaaaacgaacataaacgaaattgcaattacggaagcaagccgtcttgtagaagtattcagcggaaaaagaatttctgcaaatagaccgatcgtaggagaagacgtgtttactcagaccgcgggagtacacgcagacggagacaaaaaaggaaatttatacgcaaatcctattttaccggaaagatttggtaggaaaagaagttacgcgttaggcaaacttgcaggtaaggcgagtatctccgaaaatgtaaaacaactcggaatggttttaagtgaagtggttttacaaaaggttttagaaagggtgatcgaattaggagatcagaataaactagtgacacctgaagatcttccatttatcattgcggacgtttctggaagaaccggagaaaaggtacttacaatcaaatcttgtaatattcattccggaattggaattcgtcctcacgcacaaattgaattggaatatcagggaaagattcataaggaaatttctgaaggagacggagggtatgatgcgtttatgaatgcacttactaaaattacgaatcgcctcggtattagtattcctaaattgatagattacgaagtaaggattcctcctggtggaaaaacagatgcacttgtagaaactaggatcacctggaacaagtccttagatttagaagaggaccagactttcaaaacgatgggagttcatccggatcaaacggttgcagcggttcatgcaactgaaaagatgctcaatcaaattctacaaccatggcaaatctaa

SEQ ID NO: 162 - protein, 386 aa, Leptospira interrogans mutant
  MISC_FEATURE: Leptospira interrogans (R)-citramalate synthase mutant
MTKVETRLEILDVTLRDGEQTRGVSFSTSEKLNIAKFLLQKLNVDRVEIASARVSKGELETVQKIMEWAATEQLTERIEILGFVDGNKTVDWIKDSGAKVLNLLTKGSLHHLEKQLGKTPKEFFTDVSFVIEYAIKSGLKINVYLEDWSNGFRNSPDYVKSLVEHLSKEHIERIFLPDTLGVLSPEETFQGVDSLIQKYPDIHFEFHGHNDYDLSVANSLQAIRAGVKGLHASINGLGERAGNTPLEALVTTIHDKSNSKTNINEIAITEASRLVEVFSGKRISANRPIVGEDVFTQTAGVHADGDKKGNLYANPILPERFGRKRSYALGKLAGKASISENVKQLGMVLSEVVLQKVLERVIELGDQNKLVTPEDLPFIIADVSGR

SEQ ID NO: 163 - DNA, 1161 bp, Leptospira interrogans mutant
  misc_feature: Encodes Leptospira interrogans (R)-citramalate synthase mutant
atgacaaaagtagaaactcgattggaaattttagacgtaactttgagagacggggagcagaccagaggggtcagtttttccacttccgaaaaactaaatatcgcaaaatttctattacaaaaactaaatgtagatcgggtagagattgcgtctgcaagagtttctaaaggggaattggaaacggtccaaaaaatcatggaatgggctgcaacagaacagcttacggaaagaatcgaaatcttaggttttgtagacgggaataaaaccgtagattggatcaaagatagtggggctaaggttttaaatcttttgactaagggatcgcttcatcatttagaaaaacaattaggcaaaactccgaaagaattctttacagacgtttcttttgtaatagaatacgcgatcaaaagcggacttaaaataaacgtatatttagaagattggtccaacggtttcagaaacagtccagattacgtcaaatcgctcgtagaacatctaagtaaagaacatatagaaagaatttttcttccagacacgttaggcgttctttcgccagaagagacgtttcaaggagtggattcactcattcaaaaatacccggatattcattttgaatttcacggacataacgactacgatctttccgtggcaaatagtcttcaagcgattcgtgccggagtcaaaggtcttcacgcttctataaatggtctcggagaaagagccggaaatactccgttggaagcactcgtaaccacgattcatgataagtctaactctaaaacgaacataaacgaaattgcaattacggaagcaagccgtcttgtagaagtattcagcggaaaaagaatttctgcaaatagaccgatcgtaggagaagacgtgtttactcagaccgcgggagtacacgcagacggagacaaaaaaggaaatttatacgcaaatcctattttaccggaaagatttggtaggaaaagaagttacgcgttaggcaaacttgcaggtaaggcgagtatctccgaaaatgtaaaacaactcggaatggttttaagtgaagtggttttacaaaaggttttagaaagggtgatcgaattaggagatcagaataaactagtgacacctgaagatcttccatttatcattgcggacgtttctggaagataa

SEQ ID NO: 164 - protein, 466 aa, Escherichia coli
  MISC_FEATURE: isopropylmalate isomerase large subunit
MAKTLYEKLFDAHVVYEAENETPLLYIDRHLVHEVTSPQAFDGLRAHGRPVRQPGKTFATMDHNVSTQTKDINACGEMARIQMQELIKNCKEFGVELYDLNHPYQGIVHVMGPEQGVTLPGMTIVCGDSHTATHGAFGALAFGIGTSEVEHVLATQTLKQGRAKTMKIEVQGKAAPGITAKDIVLAIIGKTGSAGGTGHVVEFCGEAIRDLSMEGRMTLCNMAIEMGAKAGLVAPDETTFNYVKGRLHAPKGKDFDDAVAYWKTLQTDEGATFDTVVTLQAEEISPQVTWGTNPGQVISVNDNIPDPASFADPVERASAEKALAYMGLKPGIPLTEVAIDKVFIGSCTNSRIEDLRAAAEIAKGRKVAPGVQALVVPGSGPVKAQAEAEGLDKIFIEAGFEWRLPGCSMCLAMNNDRLNPGERCASTSNRNFEGRQGRGGRTHLVSPAMAAAAAVTGHFADIRNIK

SEQ ID NO: 165 - DNA, 1401 bp, Escherichia coli
  misc_feature: Encodes isopropylmalate isomerase large subunit
ttatttaatgttgcgaatgtcggcgaaatgtccggtcacagcagcagcggcagccattgccgggctgaccagatgcgtgcgcccgccgcgcccctggcggccttcaaagttacggttgctggtggaggcacaacgttcgcccggattcagacggtcgttgttcatcgccagacacattgagcagccaggcaagcgccattcaaaaccggcttcaataaagattttatccagaccttccgcttccgcctgggcttttaccgggccagagccgggaaccaccagtgcctgcacgcctggcgcgacttttcgccctttggcgatctccgctgccgcgcgtaaatcttcaatgcgcgagttggtacaggaaccgataaacactttgtcgatagccacttcggtcagcggaatacccggtttcagccccatataggccagcgctttttctgccgacgcgcgttcaaccggatcggcaaacgaagccggatcgggaatattgtcgttcacggaaatcacctggccgggattggtgccccaggtgacctgcggtgaaatttcttctgcttgcagagtgacaacggtatcgaaagttgcgccttcgtcggtttgcagggttttccagtaggcaacggcgtcgtcgaaatctttgcctttcggcgcatgcagacggcctttgacatagttaaaggtggtttcgtccggtgcaaccagaccggcttttgcgcccatttcgattgccatattgcacagggtcatacgaccttccatgcttaaatcacggattgcttcgccgcaaaactccaccacatgcccggtgccgcctgcgctaccggttttaccgataattgccagcacgatatcttttgcggtaatgcccggcgcggctttgccctggacttcaattttcatggtttttgcgcggccctgtttcagggtttgcgttgccagtacgtgttcaacttcggaagtgccgataccaaaggccagtgcgccaaacgcgccgtgggtggcggtatgcgagtcgccgcagacaatggtcatccccggcaaggtgacgccctgttccggccccattacgtggacgatcccctgatacgggtgattcaggtcatacagttcgacgccaaattctttgcagtttttgatcagttcctgcatctggatacgcgccatttcaccgcaggcattaatgtctttggtctgggtagagacgttgtgatccatggtagcgaaggttttgcccggctgacgtaccgggcgaccgtgggcgcgcagaccatcgaacgcctgcggtgaggtcacttcatgcaccaggtggcggtcgatatataacagtggggtttcgttttcggcttcgtacacaacgtgagcgtcgaacaatttttcgtataacgtcttagccat

SEQ ID NO: 166 - protein, 201 aa, Escherichia coli
  MISC_FEATURE: isopropylmalate isomerase small subunit
MAEKFIKHTGLVVPLDAANVDTDAIIPKQFLQKVTRTGFGAHLFNDWRFLDEKGQQPNPDFVLNFPQYQGASILLARENFGCGSSREHAPWALTDYGFKVVIAPSFADIFYGNSFNNQLLPVKLSDAEVDELFALVKANPGIHFDVDLEAQEVKAGEKTYRFTIDAFRRHCMMNGLDSIGLTLQHDDAIAAYEAKQPAFMN

SEQ ID NO: 167 - DNA, 606 bp, Escherichia coli
  misc_feature: Encodes isopropylmalate isomerase small subunit
ttaattcataaacgcaggttgttttgcttcataagcggcaatggcgtcgtcgtgctgcaaggtaagcccaatactgtccagaccgttcatcatgcagtggcggcggaaggcatcgatggtaaagcgataggttttctctcccgctttcacctcttgcgcttccagatccacgtcgaaatggatccccggattagctttcaccagcgcaaacagttcgtccacttctgcatcgcttaatttcaccggcagcagctggttgttaaagctattgccgtagaagatgtcagcaaaactcggcgcaatcaccactttaaaaccgtagtcggtcaatgcccagggcgcgtgctcacgcgaagagccacagccgaagttttctcgtgccagcaaaatggaagcgccctgatactgcgggaagttcagcacgaagtccgggtttggctgttggcctttttcatccagaaaacgccagtcgttaaacagatgcgcgccaaaacccgtacgggtcactttctgcaaaaactgtttcgggatgattgcatcggtatcgacattggcggcatccagcggaaccaccaggcctgtgtgtttgataaatttctctgccat

SEQ ID NO: 168 - protein, 472 aa, Bacillus subtilis
  MISC_FEATURE: isopropylmalate isomerase large subunit
MMPRTIIEKIWDQHIVKHGEGKPDLLYIDLHLIHEVTSPQAFEGLRQKGRKVRRPQNTFATMDHNIPTVNRFEIKDEVAKRQVTALERNCEEFGVRLADLHSVDQGIVHVVGPELGLTLPGKTIVCGDSHTSTHGAFGALAFGIGTSEVEHVLSTQTLWQQRPKTLEVRVDGTLQKGVTAKDVILAVIGKYGVKFGTGYVIEYTGEVFRNMTMDERMTVCNMSIEAGARAGLIAPDEVTFEYCKNRKYTPKGEEFDKAVEEWKALRTDPGAVYDKSIVLDGNKISPMVTWGINPGMVLPVDSEVPAPESFSAEDDKKEAIRAYEYMGLTPHQKIEDIKVEHVFIGSCTNSRMTDLRQAADMIKGKKVADSVRAIVVPGSQSVKLQAEKEGLDQIFLEAGFEWRESGCSMCLSMNNDVVPEGERCASTSNRNFEGRQGKGARTHLVSPAMAAMAAIHGHFVDVRKFYQEKTVV

SEQ ID NO: 169 - DNA, 1419 bp, Bacillus subtilis
  misc_feature: Encodes isopropylmalate isomerase large subunit
ttacacaactgttttttcctgataaaactttctgacatcaacgaagtgtccgtgaatggcagccatcgcagccattgccgggctgacgagatgtgttcttgcaccttttccttgtctgccctcgaagttgcggttagaggttgatgcacagcgctctccctcaggaacaacatcattattcatactcaaacacatgctgcagcctgactctctccattcaaatccagcttccaagaaaatctggtcaagcccttctttttcagcctgaagcttcacgctttgggatccgggcacgacgatggcccttacgctgtcagctaccttcttccctttgatcatgtcagcagcctgtcgaaggtcagtcatgcgggaatttgtgcaggaaccgataaatacgtgctccactttaatgtcttcaattttttggtgaggagtcaatcccatatattcataagcacgaatcgcttcttttttatcgtcttctgcagaaaagctttccggcgcaggaacttcagaatcgacaggaagaaccattcccgggttaatgccccatgtcaccataggggaaattttgttgccgtcaaggacgatagatttatcgtaaacagcgcccgggtctgtgcgcagcgccttccattcctctacggccttgtcaaattcttcgccttttggcgtgtacttgcgatttttgcaatattcaaacgtcacctcgtcaggtgcaatcaaacctgctcttgctcctgcttcaattgacatgttacaaacagtcattcgttcatccatcgtcatatttctgaatacttccccagtgtattcaatgacgtagcctgtgccgaatttcacaccgtatttgccgatgacagcaaggatgacatcctttgccgttacccctttttgaagcgttccatctacgcgcacttcaagtgtttttggacgctgctgccaaagtgtctgtgtggaaaggacatgttcaacttcactcgtcccgattccaaatgcaagagcgccgaaagcgccatgtgttgatgtatgactgtcaccgcacacaatcgttttccctggaagcgttaagcctagttcaggtccgacgacatggacaatcccttgatccacactgtgaagatcggcaaggcgcacgccaaattcctcacagtttctttcaagcgccgttacctggcgtttcgcaacttcatcctttatctcaaaacgattgacagtcgggatgttgtggtccattgtcgcaaatgtgttttggggtcttctgacctttcttcccttttgtctcaagccttcaaatgcctgaggagacgtcacctcatgaatgaggtgcaaatcaatatagagaagatccggctttccctcaccatgttttacaatatgctgatcccaaatcttttcgatgattgttcgaggcatcat

SEQ ID NO: 170 - protein, 199 aa, Bacillus subtilis
  MISC_FEATURE: isopropylmalate isomerase small subunit
MEPLKSHTGKAAVLNRINVDTDQIIPKQFLKRIERTGYGRFAFFDWRYDANGEPNPEFELNQPVYQGASILIAGENFGCGSSREHAPWALDDYGFKIIIAPSFADIFHQNCFKNGMLPIRMPYDNWKQLVGQYENQSLQMTVDLENQLIHDSEGNQISFEVDPHWKEMLINGYDEISLTLLLEDEIKQFESQRSSWLQA

SEQ ID NO: 171 - DNA, 600 bp, Bacillus subtilis
  misc_feature: Encodes isopropylmalate isomerase small subunit
tcaggcttgaagccaagagcttctttgtgattcaaattgcttgatttcatcttccagcagcagcgttaatgaaatttcatcatatccgttgatcagcatctctttccaatgcggatcaacttcaaatgaaatttgattgccttcactgtcatgaatcagctgattttcaaggtcaacagtcatttgcaatgactggttttcatactggccgacaagctgtttccaattgtcatatggcatgcggatcggaagcatgccgtttttaaagcagttctgatggaaaatatcagcgaatgacggcgcaatgataattttaaacccataatcatcaagtgcccacggagcgtgttcacgcgatgacccgcagccgaagttttctcctgctattaaaatggaagctccttgataaacaggctggtttaattcaaattcagggttcggttcaccattcgcatcatatctccagtcaaagaatgcaaaacgtccgtagcctgttctttcaatcctcttcaaaaattgcttaggaataatctggtctgtatccacattgatccgatttaatacggctgctttccccgtatgtgatttcaaaggttccat

SEQ ID NO: 172 - protein, 363 aa, Escherichia coli
  MISC_FEATURE: 3-isopropylmalate dehydrogenase
MSKNYHIAVLPGDGIGPEVMTQALKVLDAVRNRFAMRITTSHYDVGGAAIDNHGQPLPPATVEGCEQADAVLFGSVGGPKWEHLPPDQQPERGALLPLRKHFKLFSNLRPAKLYQGLEAFCPLRADIAANGFDILCVRELTGGIYFGQPKGREGSGQYEKAFDTEVYHRFEIERIARIAFESARKRRHKVTSIDKANVLQSSILWREIVNEIATEYPDVELAHMYIDNATMQLIKDPSQFDVLLCSNLFGDILSDECAMITGSMGMLPSASLNEQGFGLYEPAGGSAPDIAGKNIANPIAQILSLALLLRYSLDADDAACAIERAINRALEEGIRTGDLARGAAAVSTDEMGDIIARYVAEGV

SEQ ID NO: 173 - DNA, 1092 bp, Escherichia coli
  misc_feature: Encodes 3-isopropylmalate dehydrogenase
ttacaccccttctgctacatagcgggcaatgatatcgcccatttcatcggtactaacggcggcagcgccacgggctaaatccccggtgcgaatgccttcttctaatgcgcggttaatggcgcgttcaatggcgcaagccgcatcatcggcatccaggctgtaacgcagcagcagtgccagcgaaaggatttgtgcaatcgggttggcgatgtttttgcctgcgatatctggtgccgagccgcccgccggttcatacagtccaaaaccttgctcgttcaggctggcggaaggcaacatccccatcgagccagtgatcattgcgcactcgtcagacagaatgtcgccaaacaggttggagcacagcagaacgtcaaactgtgatggatctttaatcagctgcatggtggcgttgtcgatgtacatatgcgccagttcgacatccgggtattccgtggcgatctcgttaacgatctcccgccataaaatagaggattgcagcacgttggctttatcgatcgacgtcactttgtggcgacgcttgcgagcagattcaaacgcgatgcgggcgatacgttcgatctcaaaacggtgatacacctcggtatcaaaggctttttcatattgtccgctaccttcgcggccttttggctgaccgaaatagatgccgccggtcagttcgcgcacacacaggatgtcgaagccgtttgcggcaatgtctgcacgcagcggacagaatgcttccagcccctgatacagttttgccgggcgcaggttgctgaataatttgaagtgcttacgcagaggcagcagcgcgccgcgttctggttgctggtctggtggtaaatgttcccacttcgggccgcctaccgagccaaacagcacggcatcggcttgctcacaaccttcaaccgtcgcaggcggcagtggttgcccgtggttatcaatggctgcgccgcctacatcgtaatggctggtggtgatgcgcatcgcaaagcggttgcgcacggcatccagcactttcagcgcctgggtcatcacttccggaccaataccgtcccccggcaatacggcaatatggtaattcttcgacat

SEQ ID NO: 174 - protein, 365 aa, Bacillus subtilis
  MISC_FEATURE: 3-isopropylmalate dehydrogenase
MKKRIALLPGDGIGPEVLESATDVLKSVAERFNHEFEFEYGLIGGAAIDEHHNPLPEETVAACKNADAILLGAVGGPKWDQNPSELRPEKGLLSIRKQLDLFANLRPVKVFESLSDASPLKKEYIDNVDFVIVRELTGGLYFGQPSKRYVNTEGEQEAVDTLFYKRTEIERVIREGFKMAAARKGKVTSVDKANVLESSRLWREVAEDVAQEFPDVKLEHMLVDNAAMQLIYAPNQFDVVVTENMFGDILSDEASMLTGSLGMLPSASLSSSGLHLFEPVHGSAPDIAGKGMANPFAAILSAAMLLRTSFGLEEEAKAVEDAVNKVLASGKRTRDLARSEEFSSTQAITEEVKAAIMSENTISNV

SEQ ID NO: 175 - DNA, 1098 bp, Bacillus subtilis
  misc_feature: Encodes 3-isopropylmalate dehydrogenase
tcacacattagaaattgtattttcactcatgattgctgccttaacttcctctgtaatggcctgagtgctgctgaactcttcactccgtgccaagtctcttgttctttttccagaagccaagactttgtttaccgcatcttctacagctttcgcttcctcttcaagcccgaaagatgttctcaaaagcattgccgctgacaatatggctgcgaacggatttgccatccctttaccggcaatatcaggcgcggagccatgaacaggttcaaacagatgaaggccagagcttgataggctggctgacgggagcattccgagcgagcctgtaagcatggacgcttcatcgcttaaaatatcaccgaacatattttcagtcaccacgacatcaaattgattcggtgcataaattagctgcatggccgcgttatccacaagcatgtgctcaagcttcacatcaggaaattcttgtgcaacgtcctcagccacttcacgccacagccggcttgattcaagaacattcgctttatctacagaggtcactttgccttttctggctgccgccattttgaagccctctctgatcactcgttcaatttccgttcgcttataaaacagtgtatctactgcttcctgctcaccttcagtgtttacataacgtttgctcggctggccgaaatacaagccgcctgtgagctcacgaacgataacgaaatcaacattatctatatattcttttttcaaaggcgaagcgtcagaaaggctttcaaataccttcacaggccgcaaattcgcaaacaaatcaagctgttttctgatgctgagcagccctttttccggtctcagttccgaaggattttgatcccatttcggtccgccgacagcaccaagcaatatcgcgtctgcatttttacaagcagcaacggtttcctccgggagggggttatgatgttcatcaatagccgcccctccaatcaggccatattcaaattcaaattcatggttaaagcgttcggcaacacttttcagtacgtctgtcgctgattctaatacttcagggccgatcccgtctccgggcaatagagcaatacgtttcttcaa

SEQ ID NO: 176 - protein, 364 aa, Saccharomyces cerevisiae
  MISC_FEATURE: 3-isopropylmalate dehydrogenase
MSAPKKIVVLPGDHVGQEITAEAIKVLKAISDVRSNVKFDFENHLIGGAAIDATGVPLPDEALEASKKADAVLLGAVGGPKWGTGSVRPEQGLLKIRKELQLYANLRPCNFASDSLLDLSPIKPQFAKGTDFVVVRELVGGIYFGKRKEDDGDGVAWDSEQYTVPEVQRITRMAAFMALQHEPPLPIWSLDKANVLASSRLWRKTVEETIKNEFPTLKVQHQLIDSAAMILVKNPTHLNGIIITSNMFGDIISDEASVIPGSLGLLPSASLASLPDKNTAFGLYEPCHGSAPDLPKNKVNPIATILSAAMMLKLSLNLPEEGKAIEDAVKKVLDAGIRTGDLGGSNSTTEVGDAVAEEVKKILA

SEQ ID NO: 177 - DNA, 1095 bp, Saccharomyces cerevisiae
  misc_feature: Encodes 3-isopropylmalate dehydrogenase
atgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgttccacttccagatgaggcgctggaagcctccaagaaggctgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccaccgaagtcggtgatgctgtcgccgaagaagttaagaaaatccttgcttaa

SEQ ID NO: 178 - protein, 562 aa, Escherichia coli
  MISC_FEATURE: acetohydroxyacid synthase I, large subunit
MASSGTTSTRKRFTGAEFIVHFLEQQGIKIVTGIPGGSILPVYDALSQSTQIRHILARHEQGAGFIAQGMARTDGKPAVCMACSGPGATNLVTAIADARLDSIPLICITGQVPASMIGTDAFQEVDTYGISIPITKHNYLVRHIEELPQVMSDAFRIAQSGRPGPVWIDIPKDVQTAVFEIETQPAMAEKAAAPAFSEESIRDAAAMINAAKRPVLYLGGGVINAPARVRELAEKAQLPTTMTLMALGMLPKAHPLSLGMLGMHGVRSTNYILQEADLLIVLGARFDDRAIGKTEQFCPNAKIIHVDIDRAELGKIKQPHVAIQADVDDVLAQLIPLVEAQPRAEWHQLVADLQREFPCPIPKACDPLSHYGLINAVAACVDDNAIITTDVGQHQMWTAQAYPLNRPRQWLTSGGLGTMGFGLPAAIGAALANPDRKVLCFSGDGSLMMNIQEMATASENQLDVKIILMNNEALGLVHQQQSLFYEQGVFAATYPGKINFMQIAAGFGLETCDLNNEADPQASLQEIINRPGPALIHVRIDAEEKVYPMVPPGAANTEMVGE

SEQ ID NO: 179 - DNA, 1689 bp, Escherichia coli
  misc_feature: Encodes acetohydroxyacid synthase I, large subunit
ttattcccccaccatttcagtattcgccgcacctggcggcaccatcgggtaaactttttcttcggcatcaatgcgcacatggatcagcgccgggccagggcgattgatgatttcctgcaatgaagcctgcggatcggcttcgttattcaaatcacaggtttcgaggccgaatccggcggcaatctgcataaagttgattttgcccggataggtggcggcaaaaacgccttgctcgtagaacagactctgttgctgatgcaccagccccagcgcttcgttgttcatcagaatgattttgacatccagctgattttcactggcggtcgccatctcctgaatattcatcatcaggctgccgtcgccggagaaacacaacactttgcgatccgggttcgccagcgcagcgccaatcgccgcaggcaggccaaaacccatcgtgcccagcccaccggaggtcagccactggcgtgggcgattgagcggataagcttgcgcggtccacatctgatgctgaccaacgtcggtggtgataattgcattgtcatcgacacaggcggcaacggcgttgatcaggccgtaatggcttaacggatcgcacgctttcgggattggacacggaaactcacgctgcaaatccgctaccaactggtgccactctgcacgcggttgcgcttccaccagcgggatcaactgcgccagcacgtcatcaacatccgcctgaatcgccacgtgcggctgcttgattttacccagctctgcacggtcgatatcgacatgaatgattttggcattcggacagaactgctcggttttgccaatcgcccggtcatcaaaacgcgcaccgagcactatcaacaaatccgcctcctgcaaaatatagttggtgctgcgcacgccgtgcatccccagcatacccagcgacaacggatgcgcttttggcaacatgcccagcgccattaaagtcatggtggtaggcagttgcgctttctccgccagttcacgcacccgtgcgggcgcattgatcacaccgccgcccagataaagcaccgggcgtttggcagcgttaatcatcgccgctgcgtcacgaatgctttcttcgctaaaggcgggggcggcggctttttctgccatagcgggctgtgtttcaatctcaaaaactgccgtttgcacatccttaggaatgtctatccacaccgggcctgggcggcctgattgcgcaatgcggaaggcatcgctcatgacctgcgggagttcttcgatatgtctgaccagatagttgtgtttggtgatggggatagagatgccgtaggtgtccacttcctggaaggcgtcggtgccgatcatcgaggcgggaacctgaccagtgatgcaaatcagcgggatggagtccagccgcgcatcggcaatggcggtcaccaggttagtcgcacccggtccgctacaggccatacagaccgccggtttaccgtcggtgcgcgccattccctgagcgataaagcccgcgccctgttcatgacgggccagaatatggcggatttgcgtgctttggcttaaggcatcgtaaacaggcaggatagaaccgcccggaatgcctgtcacaatcttaatgccctgctgttccaggaaatgaacgataaattctgcgccggtaaagcgcttacgcgtcgatgttgtgcccgaacttgccat

SEQ ID NO: 180 - protein, 96 aa, Escherichia coli
  MISC_FEATURE: acetohydroxyacid synthase I, small subunit
MQNTTHDNVILELTVRNHPGVMTHVCGLFARRAFNVEGILCLPIQDSDKSHIWLLVNDDQRLEQMISQIDKLEDVVKVQRNQSDPTMFNKIAVFFQ

SEQ ID NO: 181 - DNA, 291 bp, Escherichia coli
  misc_feature: Encodes acetohydroxyacid synthase I, small subunit
ttactgaaaaaacaccgcgatcttgttaaacatcgtcggatcggactgattacgctgcactttcacgacatcttccagcttatcgatttggcttatcatctgctccagacgctggtcgtcattgaccagtagccagatatggcttttgtcgctgtcctgaatcggcagacaaagaatgccttcaacgttaaaagcgcggcgggcaaaaaggccacaaacgtgggtcattacgcccggatggttgcgaacggtgagctccagaattacgttgtcatgagttgtgttttgcat

SEQ ID NO: 182 - protein, 548 aa, Escherichia coli
  MISC_FEATURE: acetohydroxyacid synthase II, large subunit
MNGAQWVVHALRAQGVNTVFGYPGGAIMPVYDALYDGGVEHLLCRHEQGAAMAAIGYARATGKTGVCIATSGPGATNLITGLADALLDSIPVVAITGQVSAPFIGTDAFQEVDVLGLSLACTKHSFLVQSLEELPRIMAEAFDVACSGRPGPVLVDIPKDIQLASGDLEPWFTTVENEVTFPHAEVEQARQMLAKAQKPMLYVGGGVGMAQAVPALREFLAATKMPATCTLKGLGAVEADYPYYLGMLGMHGTKAANFAVQECDLLIAVGARFDDRVTGKLNTFAPHASVIHMDIDPAEMNKLRQAHVALQGDLNALLPALQQPLNINDWQLHCAQLRDEHAWRYDHPGDAIYAPLLLKQLSDRKPADCVVTTDVGQHQMWAAQHIAHTRPENFITSSGLGTMGFGLPAAVGAQVARPNDTVVCISGDGSFMMNVQELGTVKRKQLPLKIVLLDNQRLGMVRQWQQLFFQERYSETTLTDNPDFLMLASAFGIPGQHITRKDQVEAALDTMLNSDGPYLLHVSIDELENVWPLVPPGASNSEMLEKLS

SEQ ID NO: 183 - DNA, 1647 bp, Escherichia coli
  misc_feature: Encodes acetohydroxyacid synthase II, large subunit
atgaatggcgcacagtgggtggtacatgcgttgcgggcacagggtgtgaacaccgttttcggttatccgggtggcgcaattatgccggtttacgatgcattgtatgacggcggcgtggagcacttgctatgccgacatgagcagggtgcggcaatggcggctatcggttatgctcgtgctaccggcaaaactggcgtatgtatcgccacgtctggtccgggcgcaaccaacctgataaccgggcttgcggacgcactgttagattccatccctgttgttgccatcaccggtcaagtgtccgcaccgtttatcggcactgacgcatttcaggaagtggatgtcctgggattgtcgttagcctgtaccaagcacagctttctggtgcagtcgctggaagagttgccgcgcatcatggctgaagcattcgacgttgcctgctcaggtcgtcctggtccggttctggtcgatatcccaaaagatatccagttagccagcggtgacctggaaccgtggttcaccaccgttgaaaacgaagtgactttcccacatgccgaagttgagcaagcgcgccagatgctggcaaaagcgcaaaaaccgatgctgtacgttggcggtggcgtgggtatggcgcaggcagttccggctttgcgtgaatttctcgctgccacaaaaatgcctgccacctgtacgctgaaagggctgggcgcagtagaagcagattatccgtactatctgggcatgctgggaatgcatggcaccaaagcggcgaacttcgcggtgcaggagtgcgacttgctgatcgccgtgggtgcacgttttgatgaccgggtgaccggcaaactgaacaccttcgcaccacacgccagtgttatccatatggatatcgacccggcagaaatgaacaagctgcgtcaggcacatgtggcattacaaggtgatttaaatgctctgttaccagcattacagcagccgttaaatatcaatgactggcagctacactgcgcgcagctgcgtgatgaacatgcctggcgttacgaccatcccggtgacgctatctacgcgccgttgttgttaaaacaactgtcagatcgtaaacctgcggattgcgtcgtgaccacagatgtggggcagcaccagatgtgggctgcgcagcacatcgcccacactcgcccggaaaatttcatcacctccagcggcttaggcaccatgggttttggtttaccggcggcggttggcgcgcaagtcgcgcgaccaaacgataccgtcgtctgtatctccggtgacggctctttcatgatgaatgtgcaagagctgggcaccgtaaaacgcaagcagttaccgttgaaaatcgtcttactcgataaccaacggttagggatggttcgacaatggcagcaactgtttttccaggaacgatatagcgaaaccacccttaccgataaccccgatttcctcatgttagccagcgccttcggcatccctggccaacacatcacccgtaaagaccaggttgaagcggcactcgacaccatgctgaacagtgatgggccatacctgcttcatgtctcaatcgacgaacttgagaacgtctggccgctggtgccgcctggtgccagtaattcagaaatgttggagaaattatcatga

SEQ ID NO: 184 - protein, 87 aa, Escherichia coli
  MISC_FEATURE: acetohydroxyacid synthase II, small subunit
MMQHQVNVSARFNPETLERVLRVVRHRGFHVCSMNMAAASDAQNINIELTVASPRSVDLLFSQLNKLVDVAHVAICQSTTTSQQIRA

SEQ ID NO: 185 - DNA, 264 bp, Escherichia coli
  misc_feature: Encodes acetohydroxyacid synthase II, small subunit
atgatgcaacatcaggtcaatgtatcagctcgcttcaatccggaaaccttagaacgtgttttacgcgtggtgcgtcatcgtggtttccacgtctgctcaatgaatatggccgccgccagcgatgcacaaaatataaatatcgaattgaccgttgccagcccacggtcggtcgacttactgtttagtcagttaaataaactggtggacgtcgcacacgttgccatctgccagagcacaaccacatcacaacaaatccgcgcctga

SEQ ID NO: 186 - protein, 574 aa, Escherichia coli
  MISC_FEATURE: acetohydroxyacid synthase III, large subunit
MEMLSGAEMVVRSLIDQGVKQVFGYPGGAVLDIYDALHTVGGIDHVLVRHEQAAVHMADGLARATGEVGVVLVTSGPGATNAITGIATAYMDSIPLVVLSGQVATSLIGYDAFQECDMVGISRPVVKHSFLVKQTEDIPQVLKKAFWLAASGRPGPVVVDLPKDILNPANKLPYVWPESVSMRSYNPTTTGHKGQIKRALQTLVAAKKPVVYVGGGAITAGCHQQLKETVEALNLPVVCSLMGLGAFPATHRQALGMLGMHGTYEANMTMHNADVIFAVGVRFDDRTTNNLAKYCPNATVLHIDIDPTSISKTVTADIPIVGDARQVLEQMLELLSQESAHQPLDEIRDWWQQIEQWRARQCLKYDTHSEKIKPQAVIETLWRLTKGDAYVTSDVGQHQMFAALYYPFDKPRRWINSGGLGTMGFGLPAALGVKMALPEETVVCVTGDGSIQMNIQELSTALQYELPVLVVNLNNRYLGMVKQWQDMIYSGRHSQSYMQSLPDFVRLAEAYGHVGIQISHPHELESKLSEALEQVRNNRLVFVDVTVDGSEHVYPMQIRGGGMDEMWLSKTERT

SEQ ID NO: 187 - DNA, 1725 bp, Escherichia coli
  misc_feature: Encodes acetohydroxyacid synthase III, large subunit
atggagatgttgtctggagccgagatggtcgtccgatcgcttatcgatcagggcgttaaacaagtattcggttatcccggaggcgcagtccttgatatttatgatgcattgcataccgtgggtggtattgatcatgtattagttcgtcatgagcaggcggcggtgcatatggccgatggcctggcgcgcgcgaccggggaagtcggcgtcgtgctggtaacgtcgggtccaggggcgaccaatgcgattactggcatcgccaccgcttatatggattccattccattagttgtcctttccgggcaggtagcgacctcgttgataggttacgatgcctttcaggagtgcgacatggtggggatttcgcgaccggtggttaaacacagttttctggttaagcaaacggaagacattccgcaggtgctgaaaaaggctttctggctggcggcaagtggtcgcccaggaccagtagtcgttgatttaccgaaagatattcttaatccggcgaacaaattaccctatgtctggccggagtcggtcagtatgcgttcttacaatcccactactaccggacataaagggcaaattaagcgtgctctgcaaacgctggtagcggcaaaaaaaccggttgtctacgtaggcggtggggcaatcacggcgggctgccatcagcagttgaaagaaacggtggaggcgttgaatctgcccgttgtttgctcattgatggggctgggggcgtttccggcaacgcatcgtcaggcactgggcatgctgggaatgcacggtacctacgaagccaatatgacgatgcataacgcggatgtgattttcgccgtcggggtacgatttgatgaccgaacgacgaacaatctggcaaagtactgcccaaatgccactgttctgcatatcgatattgatcctacttccatttctaaaaccgtgactgcggatatcccgattgtgggggatgctcgccaggtcctcgaacaaatgcttgaactcttgtcgcaagaatccgcccatcaaccactggatgagatccgcgactggtggcagcaaattgaacagtggcgcgctcgtcagtgcctgaaatatgacactcacagtgaaaagattaaaccgcaggcggtgatcgagactctttggcggttgacgaagggagacgcttacgtgacgtccgatgtcgggcagcaccagatgtttgctgcactttattatccattcgacaaaccgcgtcgctggatcaattccggtggcctcggcacgatgggttttggtttacctgcggcactgggcgtcaaaatggcgttgccagaagaaaccgtggtttgcgtcactggcgacggcagtattcagatgaacatccaggaactgtctaccgcgttgcaatacgagttgcccgtactggtggtgaatctcaataaccgctatctggggatggtgaagcagtggcaggacatgatctattccggccgtcattcacaatcttatatgcaatcgctacccgatttcgtccgtctggcggaagcctatgggcatgtcgggatccagatttctcatccgcatgagctggaaagcaaacttagcgaggcgctggaacaggtgcgcaataatcgcctggtgtttgttgatgttaccgtcgatggcagcgagcacgtctacccgatgcagattcgcgggggcggaatggatgaaatgtggttaagcaaaacggagagaacctga

SEQ ID NO: 188 - protein, 163 aa, Escherichia coli
  MISC_FEATURE: acetohydroxyacid synthase III, small subunit
MRRILSVLLENESGALSRVIGLFSQRGYNIESLTVAPTDDPTLSRMTIQTVGDEKVLEQIEKQLHKLVDVLRVSELGQGAHVEREIMLVKIQASGYGRDEVKRNTEIFRGQIIDVTPSLYTVQLAGTSGKLDAFLASIRDVAKIVEVARSGVVGLSRGDKIMR

SEQ ID NO: 189 - DNA, 492 bp, Escherichia coli
  misc_feature: Encodes acetohydroxyacid synthase III, small subunit
atgcgccggatattatcagtcttactcgaaaatgaatcaggcgcgttatcccgcgtgattggccttttttcccagcgtggctacaacattgaaagcctgaccgttgcgccaaccgacgatccgacattatcgcgtatgaccatccagaccgtgggcgatgaaaaagtacttgagcagatcgaaaagcaattacacaaactggtcgatgtcttgcgcgtgagtgagttggggcagggcgcgcatgttgagcgggaaatcatgctggtgaaaattcaggccagcggttacgggcgtgacgaagtgaaacgtaatacggaaatattccgtgggcaaattatcgatgtcacaccctcgctttataccgttcaattagcaggcaccagcggtaagcttgatgcatttttagcatcgattcgcgatgtggcgaaaattgtggaggttgctcgctctggtgtggtcggactttcgcgcggcgataaaataatgcgttga

SEQ ID NO: 190 - protein, 573 aa, Listeria monocytogenes
  MISC_FEATURE: acetohydroxyacid synthase, large subunit
MIDTTKTNEKATKKQSKSGAELLIDALKKQQVDMIFGYPGGAVLPLYDAFYDCDIPHILTRHEQGAIHAAEGYARVTGKPGVVVVTSGPGATNVLTGIADAMSDSIPLVIFTGQVHTPGIGKDAFQEADMIGLTIPITKYNYQVRDVRDLPKIVNEAFHIASTGRKGPVVVDIPKDMGIIQTESVRPDTIDLPGYQPTYSPNPLQLEKLMQSLSAASKPLILAGAGVNHARATAELLEFAERYQIPIVNTLLGLGSFPQSHDLFLGMGGMHGSYAANMALTDCDLLINFGSRFDDRLASAPKEFATKATIAHIDIDPAEIGKIIETQIPIVADINETLTQLLQMELPVHPDTSHWYKLNMTRKNRHPFNFDRTKKAEIKPQRVIELIGEITQGEALVSTDVGQHQMWAAQFYPFQFDHQIITSGGLGTMGFGFPAAVGAQLAFPDKTVVAIVGDGGFQMTNQELAILNDYQINVKTVIINNGSLGMVRQWQEKFHGERYSHSIFTSQPDFVKLSEAYGVKGVRLTNPETLEKDLRKAFAHPGPIVIDVHVAKDELVLPMVPSGKPNHQMEGVE

SEQ ID NO: 191 - DNA, 1722 bp, Listeria monocytogenes
  misc_feature: Encodes acetohydroxyacid synthase, large subunit
gtgattgatacgacgaagacaaatgaaaaagcgacaaaaaagcaaagtaaaagtggagcagaacttttaattgacgccttaaaaaaacaacaagtagacatgatttttggttatccgggtggcgcggttcttcctctctatgatgccttttatgactgtgatattccgcatattctaacacgacatgagcaaggagcgattcatgcggcggaaggttatgctcgtgttaccgggaaacctggtgtcgttgttgtaactagtggacctggtgcaaccaacgtactaactggtatcgcggatgcaatgagtgactcgattccattagtaatttttaccggacaagttcatacgcctggtatcggaaaagatgctttccaagaagccgatatgattgggctaacgattccaattactaaatacaattaccaagtgcgtgatgttcgtgacttaccaaaaatcgtcaatgaagcttttcatattgcaagtactggtcgtaaaggccctgttgtcgtggatattccaaaagacatggggattatccaaacagagtctgtccggccagatacgattgatctgccgggttatcaaccgacttattcaccgaatccacttcaacttgaaaaactaatgcaatctctttccgccgcaagtaagccactaatacttgccggagctggcgtcaatcatgcgagagctacagctgaattactagaattcgctgaacgctatcaaattcctatcgtgaatacactgcttggtctaggaagtttcccgcaaagccatgatttattccttggtatgggtggtatgcacggttcttatgcagcaaatatggcgctaacggattgcgacttgctgattaattttggctctagattcgatgaccgtcttgcaagcgcaccgaaagaatttgccacgaaagcaaccattgctcatatcgacattgatcccgcggaaatcggcaaaattatcgaaacgcaaattccaatcgtggcggatatcaacgaaacgctcacgcaactactacaaatggaacttccggttcatccggatacatcccattggtacaaattaaatatgactcgtaaaaaccgtcatccttttaattttgatagaacgaaaaaagcggaaattaaaccacagcgtgtcattgagctaattggtgaaattacgcaaggtgaagcgcttgtttctaccgatgttggacagcatcaaatgtgggcggcgcagttttatccattccaattcgatcatcaaattattacaagtggtggtcttggcacaatgggctttggattccccgcagccgttggggcacaactcgctttcccagataaaacggtagtcgcaattgttggcgatggcggtttccaaatgaccaaccaagaactcgcgattttaaacgattatcaaatcaatgtaaaaacggtcattatcaataatggttcgcttgggatggttcgtcagtggcaagaaaaattccacggtgaaagatattcccattcgattttcacgagccaaccagattttgtcaaactatctgaagcttacggtgtcaaaggtgttcgcctgacaaatccggaaacactagaaaaagatttaagaaaagcgttcgctcacccagggccaatcgtaattgatgtccatgtagcaaaagacgaactagtacttccaatggttccaagcggcaaaccaaatcaccaaatggaaggggtggaataa

SEQ ID NO: 192 - protein, 163 aa, Listeria monocytogenes
  MISC_FEATURE: acetohydroxyacid synthase, small subunit
MRRIITATVNNSSGVLNRITGVISRRQYNIDSISVGWTEIPNVSRITIVVHVDSLYEIEQVTKQLNKQIDVLKVSDITDDAHIERELALLKINSPAALRSELNAVIEPFRATVIDVGTKNVVIQVTGTSEKIDAFVDTVRPYGIKQMARTGVTGFTRSPKKMG

SEQ ID NO: 193 - DNA, 492 bp, Listeria monocytogenes
  misc_feature: Encodes acetohydroxyacid synthase, small subunit
atgcgccgaatcattaccgctacagtaaacaactcttctggcgtattaaatcgtatcactggggttatctccagacgccaatacaatattgatagcatctctgtcggctggaccgaaatcccaaatgtttcccggattaccatcgtcgtccatgtcgattccttatacgaaatcgaacaagtaacaaaacagctcaacaaacaaattgacgtgctcaaagtgagcgatattactgacgatgcgcatatcgaacgcgaactagctttacttaaaatcaactcccccgccgccttacgatctgagttaaacgcagtcatcgaaccatttcgcgcaaccgtcattgatgtcggcacaaaaaatgtcgtcattcaagtaactggcacaagcgaaaaaattgatgctttcgttgacacggttcgtccctacggcattaaacaaatggcaagaactggcgtgactggctttacaagaagccctaaaaaaatgggttga

SEQ ID NO: 194 - protein, 491 aa, Escherichia coli
  MISC_FEATURE: acetohydroxyacid isomeroreductase
MANYFNTLNLRQQLAQLGKCRFMGRDEFADGASYLQGKKVVIVGCGAQGLNQGLNMRDSGLDISYALRKEAIAEKRASWRKATENGFKVGTYEELIPQADLVINLTPDKQHSDVVRTVQPLMKDGAALGYSHGFNIVEVGEQIRKDITVVMVAPKCPGTEVREEYKRGFGVPTLIAVHPENDPKGEGMAIAKAWAAATGGHRAGVLESSFVAEVKSDLMGEQTILCGMLQAGSLLCFDKLVEEGTDPAYAEKLIQFGWETITEALKQGGITLMMDRLSNPAKLRAYALSEQLKEIMAPLFQKHMDDIISGEFSSGMMADWANDDKKLLTWREETGKTAFETAPQYEGKIGEQEYFDKGVLMIAMVKAGVELAFETMVDSGIIEESAYYESLHELPLIANTIARKRLYEMNVVISDTAEYGNYLFSYACVPLLKPFMAELQPGDLGKAIPEGAVDNGQLRDVNEAIRSHAIEQVGKKLRGYMTDMKRIAVAG

SEQ ID NO: 195 - DNA, 1476 bp, Escherichia coli
  misc_feature: Encodes acetohydroxyacid isomeroreductase
atggctaactacttcaatacactgaatctgcgccagcagctggcacagctgggcaaatgtcgctttatgggccgcgatgaattcgccgatggcgcgagctaccttcagggtaaaaaagtagtcatcgtcggctgtggcgcacagggtctgaaccagggcctgaacatgcgtgattctggtctcgatatctcctacgctctgcgtaaagaagcgattgccgagaagcgcgcgtcctggcgtaaagcgaccgaaaatggttttaaagtgggtacttacgaagaactgatcccacaggcggatctggtgattaacctgacgccggacaagcagcactctgatgtagtgcgcaccgtacagccactgatgaaagacggcgcggcgctgggctactcgcacggtttcaacatcgtcgaagtgggcgagcagatccgtaaagatatcaccgtagtgatggttgcgccgaaatgcccaggcaccgaagtgcgtgaagagtacaaacgtgggttcggcgtaccgacgctgattgccgttcacccggaaaacgatccgaaaggcgaaggcatggcgattgccaaagcctgggcggctgcaaccggtggtcaccgtgcgggtgtgctggaatcgtccttcgttgcggaagtgaaatctgacctgatgggcgagcaaaccatcctgtgcggtatgttgcaggctggctctctgctgtgcttcgacaagctggtggaagaaggtaccgatccagcatacgcagaaaaactgattcagttcggttgggaaaccatcaccgaagcactgaaacagggcggcatcaccctgatgatggaccgtctctctaacccggcgaaactgcgtgcttatgcgctttctgaacagctgaaagagatcatggcacccctgttccagaaacatatggacgacatcatctccggcgaattctcttccggtatgatggcggactgggccaacgatgataagaaactgctgacctggcgtgaagagaccggcaaaaccgcgtttgaaaccgcgccgcagtatgaaggcaaaatcggcgagcaggagtacttcgataaaggcgtactgatgattgcgatggtgaaagcgggcgttgaactggcgttcgaaaccatggtcgattccggcatcattgaagagtctgcatattatgaatcactgcacgagctgccgctgattgccaacaccatcgcccgtaagcgtctgtacgaaatgaacgtggttatctctgataccgctgagtacggtaactatctgttctcttacgcttgtgtgccgttgctgaaaccgtttatggcagagctgcaaccgggcgacctgggtaaagctattccggaaggcgcggtagataacgggcaactgcgtgatgtgaacgaagcgattcgcagccatgcgattgagcaggtaggtaagaaactgcgcggctatatgacagatatgaaacgtattgctgttgcgggttaa

SEQ ID NO: 196 - protein, 342 aa, Bacillus subtilis
  MISC_FEATURE: acetohydroxyacid isomeroreductase
MVKVYYNGDIKENVLAGKTVAVIGYGSQGHAHALNLKESGVDVIVGVRQGKSFTQAQEDGHKVFSVKEAAAQAEIIMVLLPDEQQQKVYEAEIKDELTAGKSLVFAHGFNVHFHQIVPPADVDVFLVAPKGPGHLVRRTYEQGAGVPALFAIYQDVTGEARDKALAYAKGIGGARAGVLETTFKEETETDLFGEQAVLCGGLSALVKAGFETLTEAGYQPELAYFECLHELKLIVDLMYEEGLAGMRYSISDTAQWGDFVSGPRVVDAKVKESMKEVLKDIQNGTFAKEWIVENQVNRPRFNAINASENEHQIEVVGRKLREMMPFVKQGKKKEAVVSVAQN

SEQ ID NO: 197 - DNA, 1029 bp, Bacillus subtilis
  misc_feature: Encodes acetohydroxyacid isomeroreductase
ttaattttgcgcaacggagaccaccgcttccttcttcttgccttgtttcacaaacggcatcatttcacgaagctttcttcccactacttcgatttgatgttcgttctcgcttgcattgatagcgttgaaacgaggacggtttacttggttttcgacgatccactcttttgcgaatgtaccgttttggatatcttttaatacttctttcatagattcttttactttggcgtccacaacgcgagggcctgatacgaaatctccccactgtgctgtgtcagagattgaatatctcattcctgcaagtccttcttcgtacataaggtctacgattaatttcagctcatgaagacactcgaagtatgcaagttcaggctgataacctgcttcagttaaggtttcaaatccggctttgacaagcgcgcttaatccgccgcaaagaactgcttgctcaccgaacaaatctgtttctgtttcttctttaaatgtcgtttctaatacgcccgctcttgcgccgccgattcctttagcataagcgagggctttgtctcttgcttctccagtcacatcttgatagattgcgaacaatgcaggtacgccagctccttgctcatatgttcttcttaccaagtgtcccgggcctttaggggccactaagaatacatctacatccgccggaggaacaatttgatggaaatgcacgttaaatccatgagcgaatactaatgattttcctgctgtcaattcatctttgatttcagcttcgtatactttttgctgctgctcatccggaagcagaaccatgatgatttcggcttgggctgccgcttcttttactgaaaatactttatgtccgtcttcttgggcttgagtgaaagattttccttgtctaacaccgacgatcacgtctactccgctttctttaaggttcagggcatgtgcgtggccttgcgaaccgtacccgataaccgctactgtttttccagccaatacgttctctttgatatcaccgttataatatacttttaccat

SEQ ID NO: 198 - protein, 616 aa, Escherichia coli
  MISC_FEATURE: dihydroxyacid dehydratase
MPKYRSATTTHGRNMAGARALWRATGMTDADFGKPIIAVVNSFTQFVPGHVHLRDLGKLVAEQIEAAGGVAKEFNTIAVDDGIAMGHGGMLYSLPSRELIADSVEYMVNAHCADAMVCISNCDKITPGMLMASLRLNIPVIFVSGGPMEAGKTKLSDQIIKLDLVDAMIQGADPKVSDSQSDQVERSACPTCGSCSGMFTANSMNCLTEALGLSQPGNGSLLATHADRKQLFLNAGKRIVELTKRYYEQNDESALPRNIASKAAFENAMTLDIAMGGSTNTVLHLLAAAQEAEIDFTMSDIDKLSRKVPQLCKVAPSTQKYHMEDVHRAGGVIGILGELDRAGLLNRDVKNVLGLTLPQTLEQYDVMLTQDDAVKNMFRAGPAGIRTTQAFSQDCRWDTLDDDRANGCIRSLEHAYSKDGGLAVLYGNFAENGCIVKTAGVDDSILKFTGPAKVYESQDDAVEAILGGKVVAGDVVVIRYEGPKGGPGMQEMLYPTSFLKSMGLGKACALITDGRFSGGTSGLSIGHVSPEAASGGSIGLIEDGDLIAIDIPNRGIQLQVSDAELAARREAQDARGDKAWTPKNRERQVSFALRAYASLATSADKGAVRDKSKLGG

SEQ ID NO: 199 - DNA, 1851 bp, Escherichia coli
  misc_feature: Encodes dihydroxyacid dehydratase
atgcctaagtaccgttccgccaccaccactcatggtcgtaatatggcgggtgctcgtgcgctgtggcgcgccaccggaatgaccgacgccgatttcggtaagccgattatcgcggttgtgaactcgttcacccaatttgtaccgggtcacgtccatctgcgcgatctcggtaaactggtcgccgaacaaattgaagcggctggcggcgttgccaaagagttcaacaccattgcggtggatgatgggattgccatgggccacggggggatgctttattcactgccatctcgcgaactgatcgctgattccgttgagtatatggtcaacgcccactgcgccgacgccatggtctgcatctctaactgcgacaaaatcaccccggggatgctgatggcttccctgcgcctgaatattccggtgatctttgtttccggcggcccgatggaggccgggaaaaccaaactttccgatcagatcatcaagctcgatctggttgatgcgatgatccagggcgcagacccgaaagtatctgactcccagagcgatcaggttgaacgttccgcgtgtccgacctgcggttcctgctccgggatgtttaccgctaactcaatgaactgcctgaccgaagcgctgggcctgtcgcagccgggcaacggctcgctgctggcaacccacgccgaccgtaagcagctgttccttaatgctggtaaacgcattgttgaattgaccaaacgttattacgagcaaaacgacgaaagtgcactgccgcgtaatatcgccagtaaggcggcgtttgaaaacgccatgacgctggatatcgcgatgggtggatcgactaacaccgtacttcacctgctggcggcggcgcaggaagcggaaatcgacttcaccatgagtgatatcgataagctttcccgcaaggttccacagctgtgtaaagttgcgccgagcacccagaaataccatatggaagatgttcaccgtgctggtggtgttatcggtattctcggcgaactggatcgcgcggggttactgaaccgtgatgtgaaaaacgtacttggcctgacgttgccgcaaacgctggaacaatacgacgttatgctgacccaggatgacgcggtaaaaaatatgttccgcgcaggtcctgcaggcattcgtaccacacaggcattctcgcaagattgccgttgggatacgctggacgacgatcgcgccaatggctgtatccgctcgctggaacacgcctacagcaaagacggcggcctggcggtgctctacggtaactttgcggaaaacggctgcatcgtgaaaacggcaggcgtcgatgacagcatcctcaaattcaccggcccggcgaaagtgtacgaaagccaggacgatgcggtagaagcgattctcggcggtaaagttgtcgccggagatgtggtagtaattcgctatgaaggcccgaaaggcggtccggggatgcaggaaatgctctacccaaccagcttcctgaaatcaatgggtctcggcaaagcctgtgcgctgatcaccgacggtcgtttctctggtggcacctctggtctttccatcggccacgtctcaccggaagcggcaagcggcggcagcattggcctgattgaagatggtgacctgatcgctatcgacatcccgaaccgtggcattcagttacaggtaagcgatgccgaactggcggcgcgtcgtgaagcgcaggacgctcgaggtgacaaagcctggacgccgaaaaatcgtgaacgtcaggtctcctttgccctgcgtgcttatgccagcctggcaaccagcgccgacaaaggcgcggtgcgcgataaatcgaaactggggggttaa

SEQ ID NO: 200 - protein, 558 aa, Bacillus subtilis
  MISC_FEATURE: dihydroxyacid dehydratase
MAELRSNMITQGIDRAPHRSLLRAAGVKEEDFGKPFIAVCNSYIDIVPGHVHLQEFGKIVKEAIREAGGVPFEFNTIGVDDGIAMGHIGMRYSLPSREIIADSVETVVSAHWFDGMVCIPNCDKITPGMLMAAMRINIPTIFVSGGPMAAGRTSDGRKISLSSVFEGVGAYQAGKINENELQELEQFGCPTCGSCSGMFTANSMNCLSEALGLALPGNGTILATSPERKEFVRKSAAQLMETIRKDIKPRDIVTVKAIDNAFALDMALGGSTNTVLHTLALANEAGVEYSLERINEVAERVPHLAKLAPASDVFIEDLHEAGGVSAALNELSKKEGALHLDALTVTGKTLGETIAGHEVKDYDVIHPLDQPFTEKGGLAVLFGNLAPDGAIIKTGGVQNGITRHEGPAVVFDSQDEALDGIINRKVKEGDVVIIRYEGPKGGPGMPEMLAPTSQIVGMGLGPKVALITDGRFSGASRGLSIGHVSPEAAEGGPLAFVENGDHIIVDIEKRILDVQVPEEEWEKRKANWKGFEPKVKTGYLARYSKLVTSANTGGIMKI

SEQ ID NO: 201 - DNA, 1677 bp, Bacillus subtilis
  misc_feature: Encodes dihydroxyacid dehydratase
ctagattttcataataccgccggtgttggcacttgtcacaagtttagaataacgtgccaggtagccggttttcactttcggttcaaaacctttccagttcgcttttcgtttttcccactcttcttctggcacttgtacatccaagatgcgtttttcaatatcaacgataatatggtctccgttttcaacaaaggcaagcggcccgccctcagcggcctcaggtgatacgtggccgattgagaggccacgggaggctccggaaaaacgtccgtccgtaatcaatgccacttttggcccgagtcccattccaacgatttgggatgttggcgccagcatttccggcatgccaggtccgccttttggcccttcgtatctgatgatgacaacgtcgccttcttttacttttcggttgataatgccgtcaagcgcctcgtcctgagaatcgaatacgacagccggcccttcgtgtcttgtaatcccattctgtacgccgcctgttttaatgatagcgccgtccggagctagattaccgaataaaacagcaaggcctcccttttcagtgaatggttgatccagcgggtgaatgacgtcataatcctttacttcatgtccggcaatggtttctccaagagtttttcctgtaacagtcagcgcatctaaatgaagcgctccttctttcttcgaaagctcattcagagccgctgaaacgccgcccgcttcgtgaagatcttcaataaacacatccgatgcaggcgccagcttagccaagtgcggcacgcgctcagcgacttcgttaatgcgttctaaagagtattcaacgccggcttcgtttgcaagggcaagggtatgaagaacggtatttgtagaacctccgagcgccatatcgagtgcaaacgcgttatcaatcgcttttactgtaacaatatcacgcggtttgatatctttgcgaatcgtttccattaattgcgcagccgattttctcacaaactctttgcgttccggagatgttgccagaatggttccattacccggcaaagcaagaccaagtgcttctgacagacagttcattgagttcgccgtaaacatgcctgagcaagacccgcacgttgggcatccgaactgctctagttcttgaagctcgttttcgttgattttccctgcttggtaggcgcctaccccttcgaatactgaggaaagggagatttttcgcccgtcacttgttcttcctgccgccatcggtccgccgctgacaaaaatcgtcggaatgttgatgcgcattgccgccataagcattcccggtgtgattttgtcgcagttcggaatacagaccattccgtcaaaccagtgtgcggatacaaccgtttccacagagtctgcgataatttcacggcttggcagcgaatatctcataccgatatgccccattgcgatgccatcatctaccccaatggtattaaattcaaacggaacgccccctgcttctctgattgcttcttttacgattttcccaaactcctgcaagtgaacatgaccgggaacgatatcaatgtatgaattacacaccgcaataaacggcttgccgaaatcctcttcttttacccctgctgcacgaagcaaactgcggtgcggagctctatcgattccttgtgtgatcatattactgcgtaattctgccat

SEQ ID NO: 202 - protein, 208 aa, Escherichia coli
  MISC_FEATURE: thioesterase (TesA)
MMNFNNVFRWHLPFLFLVLLTFRAAAADTLLILGDSLSAGYRMSASAAWPALLNDKWQSKTSVVNASISGDTSQQGLARLPALLKQHQPRWVLVELGGNDGLRGFQPQQTEQTLRQILQDVKAANAEPLLMQIRLPANYGRRYNEAFSAIYPKLAKEFDVPLLPFFMEEVYLKPQWMQDDGIHPNRDAQPFIADWMAKQLQPLVNHDS

SEQ ID NO: 203 - DNA, 627 bp, Escherichia coli
  misc_feature: Encodes thioesterase (TesA)
ttatgagtcatgatttactaaaggctgcaactgcttcgccatccagtcggcaataaacggctgggcgtcgcggttgggatgaataccgtcatcctgcatccattgtggcttgaggtagacctcttccataaaaaagggcagcagcggaacatcaaactctttggcgagtttggggtaaatggcgctaaaggcttcattataacggcgaccatagtttgcaggcagacgtatttgcattaacaatggttcagcgttggcggctttgacatcctgcaaaatctggcgcagcgtttgctcggtttgctgtggctgaaaaccacgcaaaccgtcattgccgcccagttcaaccagcacccaacgcggctgatgctgtttcagcagagccggaaggcgcgccagtccttgttgcgaggtgtcgccgctgatgctggcattaactaccgacgttttactctgccacttatcattcaacaaggcaggccaggccgcgctggcagacattcgatacccggcgctcaggctatcacccagaatcaataacgtgtccgctgcggcggcacggaaggttaacaggaccaggaacaggaagggcaaatgccagcggaaaacattgttgaagttcatcat

SEQ ID NO: 204 - protein, 183 aa, Escherichia coli mutant
  MISC_FEATURE: Escherichia coli TesA mutant lacking leader sequence
MADTLLILGDSLSAGYRMSASAAWPALLNDKWQSKTSVVNASISGDTSQQGLARLPALLKQHQPRWVLVELGGNDGLRGFQPQQTEQTLRQILQDVKAANAEPLLMQIRLPANYGRRYNEAFSAIYPKLAKEFDVPLLPFFMEEVYLKPQWMQDDGIHPNRDAQPFIADWMAKQLQPLVNHDS

SEQ ID NO: 205 - DNA, 552 bp, Escherichia coli mutant
  misc_feature: Encodes Escherichia coli TesA mutant lacking leader sequence
atggcggacacgttattgattctgggtgatagcctgagcgccgggtatcgaatgtctgccagcgcggcctggcctgccttgttgaatgataagtggcagagtaaaacgtcggtagttaatgccagcatcagcggcgacacctcgcaacaaggactggcgcgccttccggctctgctgaaacagcatcagccgcgttgggtgctggttgaactgggcggcaatgacggtttgcgtggttttcagccacagcaaaccgagcaaacgctgcgccagattttgcaggatgtcaaagccgccaacgctgaaccattgttaatgcaaatacgtctgcctgcaaactatggtcgccgttataatgaagcctttagcgccatttaccccaaactcgccaaagagtttgatgttccgctgctgcccttttttatggaagaggtctacctcaagccacaatggatgcaggatgacggtattcatcccaaccgcgacgcccagccgtttattgccgactggatggcgaagcagttgcagcctttagtaaatcatgactcataa

SEQ ID NO: 206 - protein, 286 aa, Escherichia coli
  MISC_FEATURE: thioesterase (TesB)
MSQALKNLLTLLNLEKIEEGLFRGQSEDLGLRQVFGGQVVGQALYAAKETVPEERLVHSFHSYFLRPGDSKKPIIYDVETLRDGNSFSARRVAAIQNGKPIFYMTASFQAPEAGFEHQKTMPSAPAPDGLPSETQIAQSLAHLLPPVLKDKFICDRPLEVRPVEFHNPLKGHVAEPHRQVWIRANGSVPDDLRVHQYLLGYASDLNFLPVALQPHGIGFLEPGIQIATIDHSMWFHRPFNLNEWLLYSVESTSASSARGFVRGEFYTQDGVLVASTVQEGVMRNHN

SEQ ID NO: 207 - DNA, 861 bp, Escherichia coli
  misc_feature: Encodes thioesterase (TesB)
ttaattgtgattacgcatcaccccttcctgaacggtcgaggcaaccagtacgccgtcttgggtataaaactcaccgcgcacaaagccacgtgcgctggacgccgaggtgctctccacgctatacagcagccattcattcaaattaaacgggcgatggaaccacatggaatggtcaatggtggcaatctgaatccccggttcgagaaaaccgatgccgtgcggctgtagagctaccggcaggaagttaagatcagaagcgtaaccgagcagatactgatgaacgcgcaggtcatccggcacgctaccatttgcgcggatccacacctgacgatgtggttctgcgacgtgacctttcagtgggttatgaaactccaccggacggacttccagcggacgatcgcagatgaatttatctttcagcactggcggcagcaggtgcgccagcgattgggcgatttgcgtttccgaagggaggccatcaggcgctggcgcggacggcattgttttttgatgttcgaaacccgcttctggtgcctggaaagaggcagtcatataaaaaatcggtttgccgttttgaatagcagcaacccggcgggcgctgaagctgttaccgtcacgcagcgtttcgacatcataaataatcggcttcttactatcgccagggcgaagaaagtagctgtgaaacgaatgtaccagccgctcttcagggacggtctcttttgcagcatacaaggcctgacccacgacctggccgccaaacacctggcgtaaacctaaatcttcactctggccgcgaaagagtccttcctcaattttttccagatttaacaatgtcagtaaattttttagcgcctgactcat

SEQ ID NO: 208 - protein, 362 aa, Arabidopsis thaliana
  MISC_FEATURE: thioesterase (FatA)
MLKLSCNVTDSKLQRSLLFFSHSYRSDPVNFIRRRIVSCSQTKKTGLVPLRAVVSADQGSVVQGLATLADQLRLGSLTEDGLSYKEKFVVRSYEVGSNKTATVETIANLLQEVGCNHAQSVGFSTDGFATTTTMRKLHLIWVTARMHIEIYKYPAWGDVVEIETWCQSEGRIGTRRDWILKDSVTGEVTGRATSKWVMMNQDTRRLQKVSDDVRDEYLVFCPQEPRLAFPEENNRSLKKIPKLEDPAQYSMIGLKPRRADLDMNQHVNNVTYIGWVLESIPQEIVDTHELQVITLDYRRECQQDDVVDSLTTTTSEIGGTNGSATSGTQGHNDSQFLHLLRLSGDGQEINRGTTLWRKKPSS

SEQ ID NO: 209 - DNA, 1089 bp, Arabidopsis thaliana
  misc_feature: Encodes thioesterase (FatA)
atgttgaagctttcgtgtaatgtgactgattctaagttacagagaagcttactcttcttctcccattcatatcgatctgatccggtgaatttcatccgtcggagaattgtctcttgttctcagacgaagaagacaggtttggttcctttgcgtgctgttgtatctgctgatcaaggaagtgtggttcaaggtttggctactctcgcggatcagctccgattaggtagtttgactgaagatggtttatcttataaagagaagtttgttgttagatcttacgaagtgggtagtaacaaaaccgctactgttgaaaccattgctaatcttttacaggaggtgggatgtaatcatgcacaaagtgttggtttttcgactgatgggtttgcaacaacaactactatgaggaagttgcatctcatttgggttactgcgagaatgcatatcgagatctataagtaccctgcttggggtgatgtggttgagatagagacttggtgtcagagtgaaggaaggattgggacaaggcgtgattggattcttaaggattctgtcactggtgaagtcactggccgtgctacaagcaagtgggtgatgatgaaccaagacacgagacggcttcagaaagtttctgatgatgttcgggacgagtacttggtcttctgtcctcaagaaccgaggttagcatttccggaagagaataacagaagcttgaagaaaatcccgaaactcgaagatccggctcagtattcaatgattgggcttaagcctagacgagctgatctcgacatgaaccagcatgtcaataatgtcacctatattggatgggttctcgagagcataccacaagaaattgtagacacgcacgagcttcaggtcataactctggattatagaagagaatgtcaacaagacgatgtggtggattcactcaccaccaccacctctgaaattggtggaaccaatggctctgccacgtctggcacacagggccacaacgatagccagttcttgcacctcctgaggttgtctggagatggtcaggagatcaaccgcgggacaactctgtggagaaagaagccttcaagttaa

SEQ ID NO: 210 - protein, 412 aa, Arabidopsis thaliana
  MISC_FEATURE: thioesterase (FatB)
MVATSATSSFFPVPSSSLDPNGKGNKIGSTNLAGLNSAPNSGRMKVKPNAQAPPKINGKKVGLPGSVDIVRTDTETSSHPAPRTFINQLPDWSMLLAAITTIFLAAEKQWMMLDWKPRRSDMLVDPFGIGRIVQDGLVFRQNFSIRSYEIGADRSASIETVMNHLQETALNHVKTAGLLGDGFGSTPEMFKKNLIWVVTRMQVVVDKYPTWGDVVEVDTWVSQSGKNGMRRDWLVRDCNTGETLTRASSVWVMMNKLTRRLSKIPEEVRGEIEPYFVNSDPVLAEDSRKLTKIDDKTADYVRSGLTPRWSDLDVNQHVNNVKYIGWILESAPVGIMERQKLKSMTLEYRRECGRDSVLQSLTAVTGCDIGNLATAGDVECQHLLRLQDGAEVVRGRTEWSSKTPTTTWGTAP

SEQ ID NO: 211 - DNA, 1239 bp, Arabidopsis thaliana
  misc_feature: Encodes thioesterase (FatB)
atggtggccacctctgctacgtcgtcattctttcctgtaccatcttcttcacttgatcctaatggaaaaggcaataagattgggtctacgaatcttgctggactcaattctgcacctaactctggtaggatgaaggttaaaccaaacgctcaggctccacctaagattaatgggaaaaaggttggtttgcctggttctgtagatattgtaaggactgataccgagacctcatcacaccctgcgccgagaactttcatcaaccagttacctgactggagcatgcttcttgctgctataactacgattttcttagcggctgagaaacagtggatgatgcttgattggaaacctaggcgttctgacatgctggtggatccttttggtatagggagaattgttcaggatggccttgtgttccgtcagaatttttctattaggtcatatgaaataggtgctgatcgctctgcatctatagaaaccgtcatgaatcatctgcaggaaacggcgcttaatcatgttaagactgctggattgcttggagatgggtttggctctacacctgagatgtttaagaagaacttgatatgggttgtcactcgtatgcaggttgtggttgataaatatcctacttggggagatgttgttgaagtagacacctgggtcagtcagtctggaaagaatggtatgcgtcgtgattggctagttcgggactgtaatactggagaaaccttaacacgagcatcaagtgtgtgggtgatgatgaataaactgacaaggagattgtcaaagattcctgaagaggttcgaggggaaatagagccttattttgtgaattctgatcctgtccttgccgaggacagcagaaagttaacaaaaattgatgacaagactgctgactatgttcgatctggtctcactcctcgatggagtgacctagatgttaaccagcatgtgaataatgtaaagtacattgggtggatcctggagagtgctccagtgggaataatggagaggcagaagctgaaaagcatgactctggagtatcggagggaatgcgggagagacagtgtgcttcagtccctcactgcagttacgggttgcgatatcggtaacctggcaacagcgggggatgtggaatgtcagcatttgctccgactccaggatggagcggaagtggtgagaggaagaacagagtggagtagtaaaacaccaacaacaacttggggaactgcaccgtaa

SEQ ID NO: 212 - protein, 382 aa, Umbellularia  californica
  MISC_FEATURE: thioesterase
MATTSLASAFCSMKAVMLARDGRGMKPRSSDLQLRAGNAPTSLKMINGTKFSYTESLKRLPDWSMLFAVITTIFSAAEKQWTNLEWKPKPKLPQLLDDHFGLHGLVFRRTFAIRSYEVGPDRSTSILAVMNHMQEATLNHAKSVGILGDGFGTTLEMSKRDLMWVVRRTHVAVERYPTWGDTVEVECWIGASGNNGMRRDFLVRDCKTGEILTRCTSLSVLMNTRTRRLSTIPDEVRGEIGPAFIDNVAVKDDEIKKLQKLNDSTADYIQGGLTPRWNDLDVNQHVNNLKYVAWVFETVPDSIFESHHISSFTLEYRRECTRDSVLRSLTTVSGGSSEAGLVCDHLLQLEGGSEVLRARTEWRPKLTDSFRGISVIPAEPRV

SEQ ID NO: 213 - DNA, 1149 bp, Umbellularia  californica
  misc_feature: Encodes thioesterase
atggccaccacctctttagcttccgctttctgctcgatgaaagctgtaatgttggctcgtgatggccggggcatgaaacccaggagcagtgatttgcagctgagggcgggaaatgcgccaacctctttgaagatgatcaatgggaccaagttcagttacacggagagcttgaaaaggttgcctgactggagcatgctctttgcagtgatcacaaccatcttttcggctgctgagaagcagtggaccaatctagagtggaagccgaagccgaagctaccccagttgcttgatgaccattttggactgcatgggttagttttcaggcgcacctttgccatcagatcttatgaggtgggacctgaccgctccacatctatactggctgttatgaatcacatgcaggaggctacacttaatcatgcgaagagtgtgggaattctaggagatggattcgggacgacgctagagatgagtaagagagatctgatgtgggttgtgagacgcacgcatgttgctgtggaacggtaccctacttggggtgatactgtagaagtagagtgctggattggtgcatctggaaataatggcatgcgacgtgatttccttgtccgggactgcaaaacaggcgaaattcttacaagatgtaccagcctttcggtgctgatgaatacaaggacaaggaggttgtccacaatccctgacgaagttagaggggagatagggcctgcattcattgataatgtggctgtcaaggacgatgaaattaagaaactacagaagctcaatgacagcactgcagattacatccaaggaggtttgactcctcgatggaatgatttggatgtcaatcagcatgtgaacaacctcaaatacgttgcctgggtttttgagaccgtcccagactccatctttgagagtcatcatatttccagcttcactcttgaatacaggagagagtgcacgagggatagcgtgctgcggtccctgaccactgtctctggtggctcgtcggaggctgggttagtgtgcgatcacttgctccagcttgaaggtgggtctgaggtattgagggcaagaacagagtggaggcctaagcttaccgatagtttcagagggattagtgtgatacccgcagaaccgagggtgtaa

SEQ ID NO: 214 - protein, 376 aa, Cuphea hookeriana
  MISC_FEATURE: thioesterase (FatA1)
MLKLSCNAATDQILSSAVAQTALWGQPRNRSFSMSARRRGAVCCAPPAAGKPPAMTAVIPKDGVASSGSGSLADQLRLGSRTQNGLSYTEKFIVRCYEVGINKTATVETMANLLQEVGCNHAQSVGFSTDGFATTPTMRKLNLIWVTARMHIEIYKYPAWSDVVEIETWCQSEGRIGTRRDWILKDYGNGEVIGRATSKWVMMNQNTRRLQKVDDSVREEYMVFCPREPRLSFPEENNRSLRKISKLEDPAEYSRLGLTPRRADLDMNQHVNNVAYIGWALESVPQEIIDSYELETITLDYRRECQQDDVVDSLTSVLSDEESGTLPELKGTNGSASTPLKRDHDGSRQFLHLLRLSPDGLEINRGRTEWRKKSTK

SEQ ID NO: 215 - DNA, 1131 bp, Cuphea hookeriana
  misc_feature: Encodes thioesterase (FatA1)
atgttgaagctttcttgcaatgccgccaccgaccagattctgtcgtcggccgtggctcaaaccgcattatggggtcaacccagaaacagatccttttcaatgtccgcccggagaaggggagccgtttgctgcgcgcctccagctgctggaaagccccctgccatgaccgctgttatcccaaaagacggggtggcctcgtccgggtccggcagcctggccgaccagctgaggctcgggagccgtacgcagaatgggctgtcgtacacggagaagttcattgtcaggtgctacgaggtcggtattaacaagacagccactgtcgaaaccatggccaatctcttgcaggaagtaggttgtaaccatgctcagagtgttggattctcaactgacgggtttgcgacgacgcctaccatgaggaaattgaatctgatatgggttactgctcgaatgcacatagaaatttataagtacccagcatggagtgatgtggttgaaatcgagacttggtgccaaagtgaaggaagaatcggaacaagaagggattggattctcaaggattatggtaatggtgaagttattggaagagccacaagcaagtgggtgatgatgaaccagaacactagacgactccaaaaagttgatgattccgttcgagaagagtatatggttttctgtccacgcgaaccaaggttatcatttcctgaagagaacaatcggagtttgagaaaaatatctaaattggaagatcctgctgagtattcgagacttggtcttacgcctagaagagctgatctggatatgaaccagcatgtcaacaacgttgcttacataggttgggctctggagagtgtacctcaagaaataatcgactcttatgagctggaaactatcactctggactacagaagagaatgccaacaggatgacgtagtcgattcgctcaccagtgttctgtcagatgaggaatcaggaacattaccagagctcaagggaacaaatggatctgcatccaccccactgaaacgtgaccatgatggctctcgccagttcttgcacttgctgaggctctcccccgacgggctagaaataaaccgtggccgaactgaatggagaaagaaatccacgaaatag

SEQ ID NO: 216 - protein, 415 aa, Cuphea hookeriana
  MISC_FEATURE: thioesterase (FatB2)
MVAAAASSAFFPVPAPGASPKPGKFGNWPSSLSPSFKPKSIPNGGFQVKANDSAHPKANGSAVSLKSGSLNTQEDTSSSPPPRTFLHQLPDWSRLLTAITTVFVKSKRPDMHDRKSKRPDMLVDSFGLESTVQDGLVFRQSFSIRSYEIGTDRTASIETLMNHLQETSLNHCKSTGILLDGFGRTLEMCKRDLIWVVIKMQIKVNRYPAWGDTVEINTRFSRLGKIGMGRDWLISDCNTGEILVRATSAYAMMNQKTRRLSKLPYEVHQEIVPLFVDSPVIEDSDLKVHKFKVKTGDSIQKGLTPGWNDLDVNQHVSNVKYIGWILESMPTEVLETQELCSLALEYRRECGRDSVLESVTAMDPSKVGVRSQYQHLLRLEDGTAIVNGATEWRPKNAGANGAISTGKTSNGNSVS

SEQ ID NO: 217 - DNA, 1248 bp, Cuphea hookeriana
  misc_feature: Encodes thioesterase (FatB2)
atggtggctgctgcagcaagttccgcattcttccctgttccagccccgggagcctcccctaaacccgggaagttcggaaattggccctcgagcttgagcccttccttcaagcccaagtcaatccccaatggcggatttcaggttaaggcaaatgacagcgcccatccaaaggctaacggttctgcagttagtctaaagtctggcagcctcaacactcaggaggacacttcgtcgtcccctcctcctcggactttccttcaccagttgcctgattggagtaggcttctgactgcaatcacgaccgtgttcgtgaaatctaagaggcctgacatgcatgatcggaaatccaagaggcctgacatgctggtggactcgtttgggttggagagtactgttcaggatgggctcgtgttccgacagagtttttcgattaggtcttatgaaataggcactgatcgaacggcctctatagagacacttatgaaccacttgcaggaaacatctctcaatcattgtaagagtaccggtattctccttgacggcttcggtcgtactcttgagatgtgtaaaagggacctcatttgggtggtaataaaaatgcagatcaaggtgaatcgctatccagcttggggcgatactgtcgagatcaatacccggttctcccggttggggaaaatcggtatgggtcgcgattggctaataagtgattgcaacacaggagaaattcttgtaagagctacgagcgcgtatgccatgatgaatcaaaagacgagaagactctcaaaacttccatacgaggttcaccaggagatagtgcctctttttgtcgactctcctgtcattgaagacagtgatctgaaagtgcataagtttaaagtgaagactggtgattccattcaaaagggtctaactccggggtggaatgacttggatgtcaatcagcacgtaagcaacgtgaagtacattgggtggattctcgagagtatgccaacagaagttttggagacccaggagctatgctctctcgcccttgaatataggcgggaatgcggaagggacagtgtgctggagtccgtgaccgctatggatccctcaaaagttggagtccgttctcagtaccagcaccttctgcggcttgaggatgggactgctatcgtgaacggtgcaactgagtggcggccgaagaatgcaggagctaacggggcgatatcaacgggaaagacttcaaatggaaactcggtctcttag

SEQ ID NO: 218 - protein, 394 aa, Cuphea hookeriana
  MISC_FEATURE: thioesterase (FatB3)
MVAAAASSAFFSVPTPGISPKPGKFGNGGFQVKANANAHPSLKSGSLETEDDTSSSSPPPRTFINQLPDWSMLLSAITTIFGAAEKQWMMLDRKSKRPDMLMEPFGVDSIVQDGVFFRQSFSIRSYEIGADRTTSIETLMNMFQETSLNHCKSNGLLNDGFGRTPEMCKKGLIWVVTKMQVEVNRYPIWGDSIEVNTWVSESGKNGMGRDWLISDCSTGEILVRATSVWAMMNQKTRRLSKFPFEVRQEIAPNFVDSVPVIEDDRKLHKLDVKTGDSIHNGLTPRWNDLDVNQHVNNVKYIGWILKSVPTDVFEAQELCGVTLEYRRECGRDSVMESVTAMDPSKEGDRSVYQHLLRLEDGADIAIGRTEWRPKNAGANGAISTGKTSNRNSVS

SEQ ID NO: 219 - DNA, 1185 bp, Cuphea hookeriana
  misc_feature: Encodes thioesterase (FatB3)
atggtggctgccgcagcaagttctgcattcttctccgttccaaccccgggaatctcccctaaacccgggaagttcggtaatggtggctttcaggttaaggcaaacgccaatgcccatcctagtctaaagtctggcagcctcgagactgaagatgacacttcatcgtcgtcccctcctcctcggactttcattaaccagttgcccgactggagtatgcttctgtccgcaatcacgactatcttcggggcagctgagaagcagtggatgatgcttgataggaaatctaagagacccgacatgctcatggaaccgtttggggttgacagtattgttcaggatggggtttttttcagacagagtttttcgattagatcttacgaaataggcgctgatcgaacaacctcaatagagacgctgatgaacatgttccaggaaacgtctttgaatcattgtaagagtaacggtcttctcaatgacggctttggtcgtactcctgagatgtgtaagaagggcctcatttgggtggttacgaaaatgcaggtcgaggtgaatcgctatcctatttggggtgattctatcgaagtcaatacttgggtctccgagtcggggaaaaacggtatgggtcgtgattggctgataagtgattgcagtacaggagaaattcttgtaagagcaacgagcgtgtgggctatgatgaatcaaaagacgagaagattgtcaaaatttccatttgaggttcgacaagagatagcgcctaattttgtcgactctgttcctgtcattgaagacgatcgaaaattacacaagcttgatgtgaagacgggtgattccattcacaatggtctaactccaaggtggaatgacttggatgtcaatcagcacgttaacaatgtgaaatacattgggtggattctcaagagtgttccaacagatgtttttgaggcccaggagctatgtggagtcacccttgagtataggcgggaatgcggaagggacagtgtgatggagtccgttacagctatggatccctcaaaagagggagaccgatcagtgtaccagcaccttcttcggcttgaggatggggctgatatcgccataggcagaaccgagtggcggccgaagaatgcaggagccaatggggcaatatcaacaggaaagacttcaaatagaaactctgtctcttag

SEQ ID NO: 220 - protein, 382 aa, Cinnamomum camphora
  MISC_FEATURE: thioesterase (FatB)
MATTSLASAFCSMKAVMLARDGRGMKPRSSDLQLRAGNAQTSLKMINGTKFSYTESLKKLPDWSMLFAVITTIFSAAEKQWTNLEWKPKPNPPQLLDDHFGPHGLVFRRTFAIRSYEVGPDRSTSIVAVMNHLQEAALNHAKSVGILGDGFGTTLEMSKRDLIWVVKRTHVAVERYPAWGDTVEVECWVGASGNNGRRHDFLVRDCKTGEILTRCTSLSVMMNTRTRRLSKIPEEVRGEIGPAFIDNVAVKDEEIKKPQKLNDSTADYIQGGLTPRWNDLDINQHVNNIKYVDWILETVPDSIFESHHISSFTIEYRRECTMDSVLQSLTTVSGGSSEAGLVCEHLLQLEGGSEVLRAKTEWRPKLTDSFRGISVIPAESSV

SEQ ID NO: 221 - DNA, 1149 bp, Cinnamomum camphora
  misc_feature: Encodes thioesterase (FatB)
atggccaccacctctttagcttctgctttctgctcgatgaaagctgtaatgttggctcgtgatggcaggggcatgaaacccaggagcagtgatttgcagctgagggcgggaaatgcacaaacctctttgaagatgatcaatgggaccaagttcagttacacagagagcttgaaaaagttgcctgactggagcatgctctttgcagtgatcacgaccatcttttcggctgctgagaagcagtggaccaatctagagtggaagccgaagccgaatccaccccagttgcttgatgaccattttgggccgcatgggttagttttcaggcgcacctttgccatcagatcgtatgaggtgggacctgaccgctccacatctatagtggctgttatgaatcacttgcaggaggctgcacttaatcatgcgaagagtgtgggaattctaggagatggattcggtacgacgctagagatgagtaagagagatctgatatgggttgtgaaacgcacgcatgttgctgtggaacggtaccctgcttggggtgatactgttgaagtagagtgctgggttggtgcatcgggaaataatggcaggcgccatgatttccttgtccgggactgcaaaacaggcgaaattcttacaagatgtaccagtctttcggtgatgatgaatacaaggacaaggaggttgtccaaaatccctgaagaagttagaggggagatagggcctgcattcattgataatgtggctgtcaaggacgaggaaattaagaaaccacagaagctcaatgacagcactgcagattacatccaaggaggattgactcctcgatggaatgatttggatatcaatcagcacgttaacaacatcaaatacgttgactggattcttgagactgtcccagactcaatctttgagagtcatcatatttccagcttcactattgaatacaggagagagtgcacgatggatagcgtgctgcagtccctgaccactgtctccggtggctcgtcggaagctgggttagtgtgcgagcacttgctccagcttgaaggtgggtctgaggtattgagggcaaaaacagagtggaggcctaagcttaccgatagtttcagagggattagtgtgatacccgcagaatcgagtgtctaa

SEQ ID NO: 222 - protein, 366 aa, Brassica juncea
  MISC_FEATURE: thioesterase (FatA)
MLKLSCNVTNHLHTFFFSSDSSLFIPGNRRTIAVSSSQPRKPALDPLRAVISADQGSISPVNSYTPADRFRAGRLMEDGYSYKEKFIVRSYEVGINKTATVETIANLLQKVACTHVQNVGFSTDGFATTLTMRKLHLIWVTARMHIEIYRYPAWSDVVEIETWCQSEGRIGTRRDWILRDSATNEVIGRATSKWVMMNQDTRRLQRVTDEVRDEYLVFCPREPRLAFPEENNSSLKKIPKLEDPAQYSMLELKPRQADLGMNQHVNNVTYIGWVLESIPQEIIDTHELQVITLDYRRECQQDDIVDSLTTSEIPDDPISKLTGTNGSATSRVQGHNESQFLHMLRLSENGQEINRGRTQWRKKSPR

SEQ ID NO: 223 - DNA, 1101 bp, Brassica juncea
  misc_feature: Encodes thioesterase (FatA)
atgttgaagctttcgtgcaatgtgactaaccacttgcacaccttcttcttctcctccgattcctcccttttcatcccgggtaatcgccgtaccatcgccgtctcctcttctcagccaaggaaaccggctttagatcctctacgggcagttatctccgccgatcagggaagcatcagtcctgttaattcgtatacgccggcggatcggttccgagctggtcgattgatggaagatggttattcatataaagagaagttcattgttagaagctatgaggttggaatcaacaaaaccgccaccgtcgagacaattgctaatctcttacagaaggtggcatgtacccatgttcagaacgttggattctcgacggatggatttgccacaacactcaccatgaggaaactgcatctcatatgggtcactgcaagaatgcacattgagatctacagatatccagcttggagtgatgtggttgagatagagacatggtgccagagtgaaggaaggattggaacaagacgtgattggattctaagggactctgctacaaatgaagttattgggcgtgctacaagcaagtgggtgatgatgaatcaagacacaaggcggcttcaaagagttacagatgaagttcgggacgagtacttggttttctgtcctcgagaacccagactagcgtttccggaagagaacaatagcagcttaaagaaaatcccaaaactagaagatccagctcagtattctatgcttgagcttaagcctcggcaagctgatctgggcatgaaccagcacgtgaataacgtcacctacatcggatgggtgcttgagagcatacctcaagaaatcattgacacgcatgagcttcaagttataactctagattacagaagagaatgccagcaagatgacattgtcgattcactgaccacctccgaaatccccgacgacccgatctcaaagcttactgggaccaacggatctgccacgtcacgcgtacaaggacacaatgagagccaattcttgcatatgctgaggttgtcagaaaatggtcaggagatcaatcgtgggagaacacaatggagaaagaaatccccacgatga

SEQ ID NO: 224 - protein, 365 aa, Helianthus annuus
  MISC_FEATURE: thioesterase (FatA1)
MLSRGVPTATATAYNDVIKETARSVTNSRSIDSVSIRRRNNGFVSNSLCRRVAPVMAVKVDEQRTGVAVDVTEKRLADRLRMGSLTEDGLSYKERFIIRCYEVGINKTATVETIANLLQEVGGNHAQSVGFSTDGFATTTTMRKLNLIWVTSRMHIEIYRYPAWSDVVEIETWCQGEGRIGTRRDWIIKDHANGEVIGRATSKWVMMNSETRRLQKVNDDIRDEYLIFCPKTLRLAFPEENNNSLKKIAKLEDPAECSTLGLVPRRADLDMNKHVNNVTYIGWVLESIPQEVIDTHELQTITLDYRRECQHDDVVDSLTSSESPAVNGCASGENLSKFLHLLRSSGEGLELNRGRTEWRKKPAKK

SEQ ID NO: 225 - DNA, 1095 bp, Helianthus annuus
  misc_feature: Encodes thioesterase (FatA1)
atgctctccagaggtgttccgaccgccaccgccaccgcctacaatgacgtaatcaaagaaaccgctcgttccgtcaccaattcccgatctatcgattccgtttcaattcgacgaagaaacaacggttttgtgtccaattcgttgtgccggagagttgcgccggtaatggcggtgaaggttgatgagcagcggaccggagtcgcggtcgatgttacggagaaacggctcgcggaccggttgcggatggggagcttgacggaagacggattgtcgtataaggagaggtttattattaggtgttatgaggtcgggattaataagacggcgactgttgagacgattgcgaatctgttgcaggaggtaggaggaaatcatgctcagagtgtcggattttcgacggatggatttgcaactacaaccaccatgagaaagttgaatctcatatgggtcacttcacgaatgcacattgaaatttacagatatcctgcttggagtgatgtggttgaaattgagacttggtgtcaaggtgaagggagaatcgggactagacgtgattggattatcaaagatcatgccaatggtgaggtcatcggaagggctacaagcaagtgggtgatgatgaactcagaaactagaagactccagaaagtcaatgacgatataagagatgaatatttaatattttgtcccaagacactgagattagcattccctgaagagaacaacaatagcctgaaaaaaatagcaaaactggaagatcctgctgagtgttcgacactcggtcttgtgcccagacgagcggatcttgatatgaacaagcatgttaacaatgttacctacattggatgggttctcgagagcatcccacaagaagttatcgacactcatgaactacaaacaatcaccttagattacaggcgtgaatgccagcatgatgatgtagtcgattccctcacgagttctgaatcacccgctgttaacggttgtgctagtggtgaaaatttaagcaagtttttgcatctactaagatcatctggtgaaggtcttgaactaaacaggggtcgcactgaatggaggaaaaaacccgcaaaaaaa

SEQ ID NO: 226 - protein, 355 aa, Clostridium acetobutylicum
  MISC_FEATURE: butyrate kinase
MSYKLLIINPGSTSTKIGVYEGEKELFEETLRHTNEEIKRYDTIYDQFEFRKEVILNVLKEKNFDIKTLSAIVGRGGMLRPVEGGTYAVNDAMVEDLKVGVQGPHASNLGGIIAKSIGDELNIPSFIVDPVVTDELADVARLSGVPELPRKSKFHALNQKAVAKRYGKESGQGYENLNLVVVHMGGGVSVGAHNHGKVVDVNNALDGDGPFSPERAGSVPIGDLVKMCFSGKYSEAEVYGKAVGKGGFVGYLNTNDVKGVIDKMEEGDKECESIYKAFVYQISKAIGEMSVVLEGKVDQIIFTGGIAYSPTLVPDLKAKVEWIAPVTVYPGEDELLALAQGAIRVLDGEEQAKVY

SEQ ID NO: 227 - protein, 296 aa, Clostridium acetobutylicum
  MISC_FEATURE: phosphotransbutyrylase
MIKSFNEIIMKVKSKEMKKVAVAVAQDEPVLEAVRDAKKNGIADAILVGDHDEIVSIALKIGMDVNDFEIVNEPNVKKAALKAVELVSTGKADILMNGLVNTATFLKICILNKEVGLRTGKTMSHVAVFETETSDRLSFLTDVAFNTYPELKEKIDIVNNSVKVAHAIGIVNPKVAPICAVEVINPKMPSTLDAAMLSKMSDRGQIKGCVVDGPLALDIALSEEAAHHKGVTGEVAGKADIFLMPNIETGNVMYKTLTYTTDSKNGGILVGTSAPVVLTSRADSHETKMNSIALAA

SEQ ID NO: 228 - DNA, 5544 bp, Artificial sequence
  pGL10.173B plasmid
tcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcactggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcttaattaatcaggagagcgttcaccgacaaacaacagataaaacgaaaggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagctggagaccgtttaaactcaatgatgatgatgatgatggtcgacggcgctattcagatcctcttctgagatgagtttttgttcgggcccaagcttcgaattcccatatggtaccagctgcagatctcgagctcggatccatggtttattcctccttatttaatcgatacattaatatatacctctttaatttttaataataaagttaatcgataattccggtcgagtgcccacacagattgtctgataaattgttaaagagcagtgccgcttcgctttttctcagcggcgctgtttcctgtgtgaaattgttatccgctcacaattccacacattatacgagccggatgattaattgtcaacagctcatttcagaatatttgccagaaccgttatgatgtcggcgcaaaaaacattatccagaacgggagtgcgccttgagcgacacgaattatgcagtgatttacgacctgcacagccataccacagcttccgatggctgcctgacgccagaagcattggtgcaccgtgcagtcgatgataagctgtcaaaccagatcaattcgcgctaactcacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttgacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcaccattcgatggtgtcaacgtaaatgcatgccgcttcgccttcgcgcgcgaattgatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcggggccggcc

SEQ ID NO: 229 - DNA, 4559 bp, Artificial sequence
  pDG2 plasmid
ggggaattgtgagcggataacaattcccctgtagaaataattttgtttaactttaataaggagatataccatggcgcaactcactcttcttttagtcggcaattccgacgccatcacgccattacttgctaaagctgactttgaacaacgttcgcgtctgcagattattcctgcgcagtcagttatcgccagtgatgcccggccttcgcaagctatccgcgccagtcgtgggagttcaatgcgcgtggccctggagctggtgaaagaaggtcgagcgcaagcctgtgtcagtgccggtaataccggggcgctgatggggctggcaaaattattactcaagcccctggaggggattgagcgtccggcgctggtgacggtattaccacatcagcaaaagggcaaaacggtggtccttgacttaggggccaacgtcgattgtgacagcacaatgctggtgcaatttgccattatgggctcagttctggctgaagaggtggtggaaattcccaatcctcgcgtggcgttgctcaatattggtgaagaagaagtaaagggtctcgacagtattcgggatgcctcagcggtgcttaaaacaatcccttctatcaattatatcggctatcttgaagccaatgagttgttaactggcaagacagatgtgctggtttgtgacggctttacaggaaatgtcacattaaagacgatggaaggtgttgtcaggatgttcctttctctgctgaaatctcagggtgaagggaaaaaacggtcgtggtggctactgttattaaagcgttggctacaaaagagcctgacgaggcgattcagtcacctcaaccccgaccagtataacggcgcctgtctgttaggattgcgcggcacggtgataaaaagtcatggtgcagccaatcagcgagcttttgcggtcgcgattgaacaggcagtgcaggcggtgcagcgacaagttcctcagcgaattgccgctcgcctggaatctgtatacccagctggttttgagctgctggacggtggcaaaagcggaactctgcggtagcaggacgctgccagcgaactcgcagtttgcaagtgacggtatataaccgaaaagtgactgagcgcatatgtatacgaagactcgagtctggtaaagaaaccgctgctgcgaaatttgaacgccagcacatggactcgtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactata

SEQ ID NO: 230 - DNA, 5502 bp, Artificial sequence
  pDG5 plasmid
ggggaattgtgagcggataacaattcccctgtagaaataattttgtttaactttaataaggagatataccatggcgcaactcactcttcttttagtcggcaattccgacgccatcacgccattacttgctaaagctgactttgaacaacgttcgcgtctgcagattattcctgcgcagtcagttatcgccagtgatgcccggccttcgcaagctatccgcgccagtcgtgggagttcaatgcgcgtggccctggagctggtgaaagaaggtcgagcgcaagcctgtgtcagtgccggtaataccggggcgctgatggggctggcaaaattattactcaagcccctggaggggattgagcgtccggcgctggtgacggtattaccacatcagcaaaagggcaaaacggtggtccttgacttaggggccaacgtcgattgtgacagcacaatgctggtgcaatttgccattatgggctcagttctggctgaagaggtggtggaaattcccaatcctcgcgtggcgttgctcaatattggtgaagaagaagtaaagggtctcgacagtattcgggatgcctcagcggtgcttaaaacaatcccttctatcaattatatcggctatcttgaagccaatgagttgttaactggcaagacagatgtgctggtttgtgacggctttacaggaaatgtcacattaaagacgatggaaggtgttgtcaggatgttcctttctctgctgaaatctcagggtgaagggaaaaaacggtcgtggtggctactgttattaaagcgttggctacaaaagagcctgacgaggcgattcagtcacctcaaccccgaccagtataacggcgcctgtctgttaggattgcgcggcacggtgataaaaagtcatggtgcagccaatcagcgagcttttgcggtcgcgattgaacaggcagtgcaggcggtgcagcgacaagttcctcagcgaattgccgctcgcctggaatctgtatacccagctggttttgagctgctggacggtggcaaaagcggaactctgcggtagcaggacgctgccagcgaactcgcagtttgcaagtgacggtatataaccgaaaagtgactgagcgcatatgaaagctggcattcttggtgttggacgttacattcctgagaaggttttaacaaatcatgatcttgaaaaaatggttgaaacttctgacgagtggattcgtacaagaacaggaatagaagaaagaagaatcgcagcagatgatgtgttttcatcacacatggctgttgcagcagcgaaaaatgcgctggaacaagctgaagtggctgctgaggatctggatatgatcttggttgcaactgttacacctgatcagtcattccctacggtgtcttgtatgattcaagaacaactcggcgcgaagaaagcgtgtgctatggatatcagcgcggcttgtgcgggcttcatgtacggggttgtaaccggtaaacaatttattgaatccggaacctacaagcatgttctagttgttggtgtagagaagctctcaagcattaccgactgggaagaccgcaatacagccgttctgtttggagacggagcaggcgctgcggtagtcgggccagtcagtgatgacagaggaatcctttcatttgaactaggagccgacggcacaggcggtcagcacttgtatctgaatgaaaaacgacatacaatcatgaatggacgagaagttttcaaatttgcagtccgccaaatgggagaatcatgcgtaaatgtcattgaaaaagccggactttcaaaagaggatgtggactttttgattccgcatcaggcgaacatccgtatcatggaagctgctcgcgagcgtttagagcttcctgtcgaaaagatgtctaaaactgttcataaatatggaaatacttctgccgcatccattccgatctctcttgtagaagaattggaagccggtaaaatcaaagacggcgatgtggtcgttatggtagggttcggcggaggactaacatggggcgccattgcaatccgctggggccgataaaaaaaaggtgaggtgcactcgagtctggtaaagaaaccgctgctgcgaaatttgaacgccagcacatggactcgtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactata

SEQ ID NO: 231 - DNA, 10460 bp, Artificial sequence
  pKZ4 plasmid
tcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcactggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcttaattaatcaggagagcgttcaccgacaaacaacagataaaacgaaaggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagctggagaccgtttaaactcaatgatgatgatgatgatggtcgacggcgctattcagatcctcttctgagatgagtttttgttcgggcccaagcttcgaattctcagatatgcaaggcgtggcccaacgcgcgtagggcggcttcttgcaccgcttcacccaacgtggggtgggcatgaatggtgccggccacatcttccaggcacgcgcccatctccagcgattgggcaaacgcggtggacagctcggagaccgccacgccaaccgcctgccaacccacgatcaggtggttgtcacggcgcgccaccacccgcacgaaaccgcttttcgactccaggctcatggcccggccattggcggcaaacgggaactgcgcgacgatgcagtccagggcctgctggctggcttgttccggggtcttgccgaccaccaccacttccgggtcggtaaagcacacggcggcaatcgctgccggctcgaagcgtcgggccttgccggcgatgatttcggcgaccatctcgccttgggccatggcccggtgcgccagcatcggttcgccagcgacgtcgccaatggcccagacgttgtgcatgctggtatgacagcgctcgtcgatggcaatggcggtgccgttcatcttcaggtccaggcattccaggttgaagcccttggtgcgtggccggcggcccacggccaccagtacctgatcggcttcaagacgcagttgcccacccttgccgtcgctggccagcaggcagccattttcgtagccctcgacgctgtggcccaggtgcaacgcgatgcccagtttcttcagcgactcggccaccggggcggtcaattcgctgtcgtaggtcggcaggatgcgttcgcgcgcttccaccacactcacctgtgcacccagcttgcgataggcaatgcccagctccaggccgatatagccaccgccgaccaccaccaggtgttgcggcagggctttcggcgccagggcttcggtcgaggaaatcaccgggccacccagcggcagcatcggcagttcgacactggtggaaccggtcgccagcaacagatgctcgcactggatacgctggccatcgacctcgacctgcttgccgtccagtaccttggcccagccatgcaccactttcaccccgtgctttttcagcaaggcggcaacaccggtggtcagacggtcgacaatgccgtccttccaggtgacgctctggccgatgtccaggcgcggcgaagccacgctgatgcccagcggcgagggttcggtaaagcgcgaggcttggtgaaactgctcggccacgtggatcagcgccttggacgggatgcagccgatgttcaggcaggtgccgcccagtgcctggccttccaccagtacggtaggaatgcccagttgcccggcgcggatggctgctacatagccgccagggccgccgccgatgatcaacagggtagtctggataatctgttgcatgctcactccacgaacaggcaggcgggttgttcgagcaggccacgcacggcctggatgaacagggcggcgtccatgccatcgaccacgcggtggtcgaacgagctggacaggttcatcatcttgcgcacgacgatctggccatcaatcaccaccggtcgttcgaccatgcggttgaccccgacgattgccacttccggggtgttgaccaccggcgtgctgacaatgccacccaaggcgccgaggctggtcagggtgatggtcgagccggacagctcctcgcggctggccttgttgttacgtgcagcgttggccaggcgcgaaatctcgccggcattggcccacaggctgcccgcttcggcgtggcgcagcacgggtaccatcaggccgttgtcaccctgggtggcaatgcccacatgcaccgcgccatggcgggtgatgatctgcgcttcgtcgtcgtaggtcgcgttgatctgcgggaagtcacgcagcgccacgacgagggcgcgcaccaggaatggcagcaaggtcagtttgccgcggctgtcgccgtgcttgctgttgagttgctggcgcagggcttccagggcggtgacgtcgatttcctcgacataactgaagtgcgcgacccggcgtttggcgtcctgcatgcgctgggcgatcttgcggcgcaggccgatcaccggcacctgctcgctgtcggtgcgcttggcataaccatcaggtgcttgcccggcattgctttgcggcttgctcatgaaggcgtcgaggtcttcgtgcagaatgcgcccggccgggccgctaccatgcacataacgcagttcgataccggcgtccagggcgcgtttgcgcacggccggcgaggccagcggcttgtcgcccggctggcgcggcacgatgggcgcagcttcgtggttggcgggcgcctggtacacggcgggttttacgtctttctgcggttccggcttggctgcaatcggggcggccggggcctctaccggttttggctgaggcacgtccacatggttgccgctgccttccacttcgatgcggatcagttcgctaccgaccgccatcacttccccgggctggccacccagggccaacaccttgccgctgaccggcgaggggatttccacggtggccttgtcggtcatgacgtcggccaccacctggtcctcggcgatgatgtcgccgaccttgacgaaccattccaccaactcgacctgcgcgatgccttcgccaatgtccggcatcttgatgacgtgcgtgcccattcagacctccatgacctttttcagtgccgcacctacccgcgaagggccggggaagtaagcccattcctgtgcgtgagggtagggggtgtcccagccggtgacgcgctcgatcggcgcctccaggtggtggaagcagtgctcctgcaccagcgacaccagctcggcaccgaagccgcaggtgcgggtggcctcgtgcaccaccacgcaacggccagtctttttcaccgactcgacgatagtgtccaggtccagcggccacaggctgcgcaggtcgatcacttcggcatcgacgccgctttcttcggcggccacctgggccacgtacaccgtggtgccgtaagtcagtacggtcacgtcattgccagggcgggtaatggcggccttgtccagcggtacggtgtaatagccgtcgggcacggcgctgtgcgggtgcttcgaccatggggttacagggcggtcgtggtggccatcgaacgggccgttgtacagacgtttgggctccaggaagattaccgggtcgtcgcattcgatcgaggcaatcagcaggcctttggcgtcataagggttggacggcatcacggtgcgcaggccgcagacctgggtgaacatcgcttccgggctctggctgtgagtctggccgccatagatgccgccgccgcaaggcatgcgcagggtcagcggggcaatgaactcgccggccgaccggtaacgcaggcgggccagctcggagacgatctggtcggaggccgggtagaagtagtcggcgaactggatctccaccaccgggcgcaggccataggcgcccatgcctacggcggtaccgacgatgccgctctcggagatgggcgcgtcgaacacgcgcgatttgccgtacttgttctgcaggccttcggtgcagcggaacacgccgccgaagtaaccgacgtcctggccgtacaccaccacattgtcgtcgcgctcaagcatgacatccatggccgagcgcagggcctggatcatggtcatggtagtggtggccatggcggtttccgggttgatgctgttgttgtggtcgttcatctcaaacccccagttcctggcgttgacggcgcaggtgttcgggcatctccttgtacacatcctcgaacatcgaggcggcgctcgggatgtgcccgttagccagggtgccgtactgctcggcttctttctgtgcggcaatcaccgcagcttcgagctcggccgtgacggcttggtgttcttcttcggaccagtggccgatcttgatcaggtgctgcttcaggcgggcgatcgggtcacccagcgggaagtggctccagtcatcggcagggcggtacttggaggggtcgtccgacgtcgagtgcgggccggcacggtaggtgacccactcgatcaggcttgggcccaggccgcggcgggcgcgctcggcagcccagcgcgaggcggcgtacacggcgacgaagtcgttgccgtcaacccgcagcgaggcaatgccgcagcccacgccacggccggcgaaggtggtcgactcgccaccggcgatggcctggaaggtagaaatcgcccactggttgttgaccacattgaggatcaccggggcgcggtaaacgtgggcaaaggtgagggcggtgtggaagtccgactcggcggtggctccgtcaccgatccacgccgaagcaatcttggtatcgcccttgatcgccgaggccatggcccagccgactgcctgcacgaactgggtcgccaggttgccgctgatggtgaagaagccggcttcgcgcaccgagtacatgatcggcaactggcggcccttgagggggtcgcgctcgttggacagcagttggcagatcatctcgaccagcgatacgtcgcgggccatcaggatgctttgctggcggtaggtcgggaagcacatgtcggtgcggttcagcgccagcgcctggccactgccgatggcttcttcgcccaggctttgcatgtagaaggacatcttcttctggcgctgggcaaccaccatgcggctgtcgaagatccgcgtcttgagcatggcgcgcatgccttgacgaaggatctgtgggtcgatgtcttcggcccaggggccttgcgcatcaccttgctcgtcgagcacgcggaccaggctgtaggacaggtcggcagtgtcggcagcatcgacatcgatcgcgggtttacgggcttgacctgcatcgttgaggcgcaggtaggaaaaatcggtctggcagcctggccggccggtgggctcgggcacatgcaaacgcaggggggcgtactcgttcatggatccatggtttattcctccttatttaatcgatacattaatatatacctctttaatttttaataataaagttaatcgataattccggtcgagtgcccacacagattgtctgataaattgttaaagagcagtgccgcttcgctttttctcagcggcgctgtttcctgtgtgaaattgttatccgctcacaattccacacattatacgagccggatgattaattgtcaacagctcatttcagaatatttgccagaaccgttatgatgtcggcgcaaaaaacattatccagaacgggagtgcgccttgagcgacacgaattatgcagtgatttacgacctgcacagccataccacagcttccgatggctgcctgacgccagaagcattggtgcaccgtgcagtcgatgataagctgtcaaaccagatcaattcgcgctaactcacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttgacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcaccattcgatggtgtcaacgtaaatgcatgccgcttcgccttcgcgcgcgaattgatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcggggccggcc

SEQ ID NO: 232 - DNA, 4732 bp, Listeria monocytogenes
  misc_feature: BKD operon
gtggcaacagaatatgatgtcgttattcttggtggaggaactggcggttacgtcgcagccattcaagcagctaagaatggccaaaaagtagccgtcgttgaaaaagggaaagttggtggaacgtgtcttcaccgtggatgtattccaacgaaagcgttattacgttcagcagaagttctgcaaacagtaaaaaaagcaagtgaatttggtatttctgtagaaggaactgctggaatcaattttttacaagcacaagaaagaaaacaacaaatagtcgatcaattagaaaaaggaatccatcaattatttaaacaaggtaaaattgacttgtttgtagggacgggaaccattttaggaccatctattttttcaccaacagctggaacggtttcagtcgaatttgaagatggctctgaaaatgaaatgctcattcctaaaaacttaattatcgcgacaggctccaaaccgcgtacattaaatggtttaagcattgatgaagaaaatgttttatcatctgacggcgcgctaaacctagaaactttaccaaaatcaattattatcgttggcggtggagttatcgggatggaatgggcttcaatgatgcatgattttggcgtagaagttaccgtgctagaatatgcagatcgaattttaccaacagaagataaagaagtagccaaagaattagcaagactttataaaaagaaaaaattaaacatgcatacatctgctgaagttcaagcagctagttataaaaaaacggatactggtgtggaaattaaagcaattattaaaggtgaagagcaaactttcacagcagacaaaattctcgtttctgtcggtcgttcagctaacacagaaaatatcggtttacaaaacacggatatcgcgaccgaaaacggctttatccaagtaaatgatttttatcaaacaaaagaaagccacatctacgcgattggtgattgcattccaacaattcagcttgcgcacgttgcgatggaagaaggaacgattgcagccaaccatattgccggaaaagtggctgaaaaacttgactacgacttagttccccgctgtatctatacttctacagaaatcgcaagtgtcggtatcacagaagaacaagcaaaagaacgtggttatgaagtgaaaaaaggcaaatttttcttccgtggcatcgggaaagcgctcgtttacggagagtcagatggcttcattaaacttattgcagataaaaaaacagacgatatcctaggcgttagcatgattggaccgcacgtgacggacatgattagcgaagccgctttagcccaagttttaaatgcaacgccgtgggaagtgggtaacaccattcacccgcacccaactttatcagaaagttttagagaagctgcccttgctgtggatggcaatgcaattcacggttaatacagctttaaaggaggaacaaaaatgactttaaaagaagcaggtttaacagaagataaattaattaaaatgtatgaaacgatgctaatggcaagaagactggatgaacgtatgtggttgctgaaccgttctgggaaaattccttttactatttctggacaaggacaagaaacggcacaaattggcgctgcgtttgcctttgatttagataaagattatgcattaccatattaccgtgatttagcagtggttctagcattcgggatgacagcgaaagatattatgttatccgcgttcgctaaagcggaagatccaaactctggcggacgacaaatgccagcccactttggtcaaaaagaaaaccgcattgtcactcaaagttcgcctgtaactacccagttcccgcatgcaacagggattggacttgcagcgaaaatggctggtgatgagattgcgatatatgcttcaaccggtgaaggatcttctaaccaaggcgatttccacgaaggaatcaactttgcatctgtacataagttgccagttgttttcgtgattcacaataaccaatatgctatttccgttccagcatcgaaacaatatgccgctgaaaaactatccgaccgagcaattggttacggcatccctggtgaacgtgtagatggaacgaatatgggagaagtatacgcggcatttaaacgtgcagcagatcgtgcaagaaacggcgagggacctactttaattgaaacagtttcttaccgcttcacaccacactcctccgatgatgacgatagtagttatcgttccagagaagaagttgacgaagcaaaaggaaaagatccactgaaaattttccaagcagaattactggaagaaggttacttaacagaagaaaaaatcgctgaaatcgaaaaaaacattgcgaaagaagttaacgaagcaaccgattatgcggaaagtgcagcatacgctgaaccagaatcatctttactttatgtatatgatgaagaagcgaatagctgattaggagggaatttgaatgccagtcatttcatatattgatgcaataaccatggcgcttaaagaagaaatggagcgcgacgataaagtatttattttaggagaagatgtaggtaaaaaaggtggcgtttttaaagcgactgctggtttatatgatgagtttggtgaagaccgagttcttgatacaccacttgctgaatcggctattgccggagtaggaattggagcggcgatgtatggctatcgtccagttgcagaaatgcagtttgcggactttattatgcctgctgtcaaccaaattatttcagaagcttccagaattcgctaccgttctaataacgattggtcttgcccaatggttattcgcgcaccttttggcggtggggtacacggagcactttaccattcacaatctgttgaaaaagtattctttggacaaccaggtttgaaaattgttgttccatcctcaccatatgatgcgaagggacttttaaaagcagcgattcgtgacaacgatccagtacttttctttgagcataaacgcgcctatcgcttgctgaaaggcgaagtaccagaaacagattatatcgtaccaatcggtgaagcaaatgtcgttcgtgaaggcgatgatattacagttattacttatggacttgctgttcaatttgctcaacaagctgcggaacgtttagccgctgaaggtgtcgaagcgcatattctggatttacgtacgatttatccattagaccaagaagcgattatcgaagcaacgaaaaaaactggtaaagtacttcttgttacggaagataataaacaaggaagtattattagtgaagtggcggcaatcatttcggaacattgtctatttgatttagatgcaccgattgctagactcgcaggaccagataccccagcgatgccttttgctccaacgatggaaaaacactttatgattaatccagataaagtggcggatgcaatgaaagaattagcggaattttagacccgttttaaattaaaggagtgaagacccgtggcagttgaaaaaatcaccatgcccaaattaggggaaagtgtaacagaaggaacgattagttcatggttagttaaaccaggcgatacagttgaaaagtatgatgctatcgcagaagtacttactgacaaagtaacagcagaaatcccatcttcttttagcggaacaattaaagaaattttagccgaagaagatgaaacactagaagtaggcgaagttatttgtacaattgaaacagcagacgcaggaagttcggaacctgtagctgaagtagaacaaacagaaacaaaagcgccagaaaaacaagaaacaaaacaagtgaaactagcagatgcaccagctagtggaagattttctccagcggtactacgaattgctggtgaaaacaatatcgatttatccactgtagaaggcacaggtaaaggtggccgaattacaagaaaagacttacttcaagtcattgaaaacggaccagtagctactaaagcagaagtgcaaagtcaaagcgcaccgcaagaaaaaactgctacaccagctcctgtacgttcagcagcaggtgacagagaaatcccaatcaatggcgtaagaaaagccattgctaaacatatgagcgtgagcaaacaagaaattccgcatgcttggatgatggtggaagtggatgcaacaggtcttgttcgctatcgtaatgcagttaaagacagctttaaaaaagaagaaggttattcattaacttatttcgcctttttcatcaaagccgttgcacaagcattgaaagaattcccgcaacttaacagcacatgggcaggcgataaaattattgagcacgcgaatatcaatatttcgattgcgattgcagctggtgatttattgtacgttccagttattaaaaatgcggacgaaaaatccattaaaggcattgctcgcgaaattagcgaacttgctggaaaagcgcgtaatggtaaactaagccaagccgatatggaaggtggcactttcacagtgaatagtactggttcatttggctctgttcaatcaatggggattattaatcacccacaagcagcaattcttcaagtggaatccattgttaaacgtcctgtcattattgatgatatgattgctgtacgagatatggtgaacctatgtctttccatcgatcaccgtattttagatggcttactagcaggtaaattcttacaagcaattaaagccaatgtcgaaaagatttccaaagaaaatacagcattgtattaa

SEQ ID NO: 233 - DNA, 5733 bp, Artificial sequence
  pACYC-PTrc vector
actcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccttaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgccaacatagtaagccagtatacactccgctagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctcaaagatgcaggggtaaaagctaaccgcatctttaccgacaaggcatccggcagttcaacagatcgggaagggctggatttgctgaggatgaaggtggaggaaggtgatgtcattctggtgaagaagctcgaccgtcttggccgcgacaccgccgacatgatccaactgataaaagagtttgatgctcagggtgtagcggttcggtttattgacgacgggatcagtaccgacggtgatatggggcaaatggtggtcaccatcctgtcggctgtggcacaggctgaacgccggaggatcctagagcgcacgaatgagggccgacaggaagcaaagctgaaaggaatcaaatttggccgcaggcgtaccgtggacaggaacgtcgtgctgacgcttcatcagaagggcactggtgcaacggaaattgctcatcagctcagtattgcccgctccacggtttataaaattcttgaagacgaaagggcctcgtgatacgcctatttttataggttaatgtcatgataataatggtttcttagacgtcttaattaatcaggagagcgttcaccgacaaacaacagataaaacgaaaggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagctggagaccgtttaaactcaatgatgatgatgatgatggtcgacggcgctattcagatcctcttctgagatgagtttttgttcgggcccaagcttcgaattcccatatggtaccagctgcagatctcgagctcggatccatggtttattcctccttatttaatcgatacattaatatatacctctttaatttttaataataaagttaatcgataattccggtcgagtgcccacacagattgtctgataaattgttaaagagcagtgccgcttcgctttttctcagcggcgctgtttcctgtgtgaaattgttatccgctcacaattccacacattatacgagccggatgattaattgtcaacagctcatttcagaatatttgccagaaccgttatgatgtcggcgcaaaaaacattatccagaacgggagtgcgccttgagcgacacgaattatgcagtgatttacgacctgcacagccataccacagcttccgatggctgcctgacgccagaagcattggtgcaccgtgcagtcgatgataagctgtcaaaccagatcaattcgcgctaactcacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttgacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcaccattcgatggtgtcaacgtaaatgcatgccgcttcgccttcgcgcgcgaattgatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcggggccggcctcg

SEQ ID NO: 234 - DNA, 193 bp, Artificial sequence
  PTrc promoter
ctgttgacaattaatcatccggctcgtataatgtgtggaattgtgagcggataacaatttcacacaggaaacagcgccgctgagaaaaagcgaagcggcactgctctttaacaatttatcagacaatctgtgtgggcactcgaccggaattatcgattaactttattattaaaaattaaagaggtatatatta

SEQ ID NO: 235 - DNA, 193 bp, Artificial sequence
  PTrc2 promoter
ctgttgacaattaatcatccggctcgtgtaatgtgtggaattgtgagcggataacaatttcacacaggaaacagcgccgctgagaaaaagcgaagcggcactgctctttaacaatttatcagacaatctgtgtgggcactcgaccggaattatcgattaactttattattaaaaattaaagaggtatatatta

SEQ ID NO: 236 - DNA, 5978 bp, Artificial sequence
  pDS80 plasmid
cactataccaattgagatgggctagtcaatgataattactagtccttttcctttgagttgtgggtatctgtaaattctgctagacctttgctggaaaacttgtaaattctgctagaccctctgtaaattccgctagacctttgtgtgttttttttgtttatattcaagtggttataatttatagaataaagaaagaataaaaaaagataaaaagaatagatcccagccctgtgtataactcactactttagtcagttccgcagtattacaaaaggatgtcgcaaacgctgtttgctcctctacaaaacagaccttaaaaccctaaaggcgtcggcatccgcttacagacaagctgtgaccgtctccgggagctgcatgtgtcagaggttttcaccgtcatcaccgaaacgcgcgaggcagcagatcaattcgcgcgcgaaggcgaagcggcatgcatttacgttgacaccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgttaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgatctggtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattttcagatctctcacctaccaaacaatgcccccctgcaaaaaataaattcatataaaaaacatacagataaccatctgcggtgataaattatctctggcggtgttgacataaataccactggcggtgatactgagcacagaatattcacacaggaaacagcgccgctgagaaaaagcgaagcggcactgctctttaacaatttatcagacaatctgtgtgggcactcgaccggaattatcgattaactttattattaaaaattaaagaggtatatattaatgtatcgattaaataaggaggaataaaccatggatccgagctcgagatctgcagctggtaccatatgggaattcgaagcttgggcccgaacaaaaactcatctcagaagaggatctgaatagcgccgtcgaccatcatcatcatcatcattgagtttaaacggtctccagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgacgcctgatgcggtattttctccttacgcatctgtgcggtatttcacaccgcatatggtgcactctcagtacaatctgctctgatgccgcatagttaagccagccccgacacccgccaacacccgctgacgagcttagtaaagccctcgctagattttaatgcggatgttgcgattacttcgccaactattgcgataacaagaaaaagccagcctttcatgatatatctcccaatttgtgtagggcttattatgcacgcttaaaaataataaaagcagacttgacctgatagtttggctgtgagcaattatgtgcttagtgcatctaacgcttgagttaagccgcgccgcgaagcggcgtcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactttgttttagggcgactgccctgctgcgtaacatcgttgctgctccataacatcaaacatcgacccacggcgtaacgcgcttgctgcttggatgcccgaggcatagactgtaccccaaaaaaacagtcataacaagccatgaaaaccgccactgcgccgttaccaccgctgcgttcggtcaaggttctggaccagttgcgtgagcgcatacgctacttgcattacagcttacgaaccgaacaggcttatgtccactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccagcttctgtatggaacgggcatgcggatcagtgagggtttgcaactgcgggtcaaggatctggatttcgatcacggcacgatcatcgtgcgggagggcaagggctccaaggatcgggccttgatgttacccgagagcttggcacccagcctgcgcgagcaggggaattaattcccacgggttttgctgcccgcaaacgggctgttctggtgttgctagtttgttatcagaatcgcagatccggcttcagccggtttgccggctgaaagcgctatttcttccagaattgccatgattttttccccacgggaggcgtcactggctcccgtgttgtcggcagctttgattcgataagcagcatcgcctgtttcaggctgtctatgtgtgactgttgagctgtaacaagttgtctcaggtgttcaatttcatgttctagttgctttgttttactggtttcacctgttctattaggtgttacatgctgttcatctgttacattgtcgatctgttcatggtgaacagctttgaatgcaccaaaaactcgtaaaagctctgatgtatctatcttttttacaccgttttcatctgtgcatatggacagttttccctttgatatgtaacggtgaacagttgttctacttttgtttgttagtcttgatgcttcactgatagatacaagagccataagaacctcagatccttccgtatttagccagtatgttctctagtgtggttcgttgtttttgcgtgagccatgagaacgaaccattgagatcatacttactttgcatgtcactcaaaaattttgcctcaaaactggtgagctgaatttttgcagttaaagcatcgtgtagtgtttttcttagtccgttatgtaggtaggaatctgatgtaatggttgttggtattttgtcaccattcatttttatctggttgttctcaagttcggttacgagatccatttgtctatctagttcaacttggaaaatcaacgtatcagtcgggcggcctcgcttatcaaccaccaatttcatattgctgtaagtgtttaaatctttacttattggtttcaaaacccattggttaagccttttaaactcatggtagttattttcaagcattaacatgaacttaaattcatcaaggctaatctctatatttgccttgtgagttttcttttgtgttagttcttttaataaccactcataaatcctcatagagtatttgttttcaaaagacttaacatgttccagattatattttatgaatttttttaactggaaaagataaggcaatatctcttcactaaaaactaattctaatttttcgcttgagaacttggcatagtttgtccactggaaaatctcaaagcctttaaccaaaggattcctgatttccacagttctcgtcatcagctctctggttgctttagctaatacaccataagcattttccctactgatgttcatcatctgagcgtattggttataagtgaacgataccgtccgttctttccttgtagggttttcaatcgtggggttgagtagtgccacacagcataaaattagcttggtttcatgctccgttaagtcatagcgactaatcgctagttcatttgctttgaaaacaactaattcagacatacatctcaattggtctaggtgattttaat

SEQ ID NO: 237 - DNA, 3227 bp, Artificial sequence
  p100.38 plasmid
gacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttgtgcatccgaagatcagcagttcaacctgttgatagtacgtactaagctctcatgtttcacgtactaagctctcatgtttaacgtactaagctctcatgtttaacgaactaaaccctcatggctaacgtactaagctctcatggctaacgtactaagctctcatgtttgaacaataaaattaatataaatcagcaacttaaatagcctctaaggttttaagttttataagaaaaaaaagaatatataaggcttttaaagctagcttttaaggtttcaccatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaagacagctgtctcttatacacatctcaaccctgaagctcttgttggctagtgcgtagtcgttggcaagctttccgctgtttctgcattcttacgttttaggatgcatatggcggccgcataacttcgtatagcatacattatacgaagttatctagagttgcatgcctgcaggtccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcgactctagataacttcgtatagcatacattatacgaagttatggatccagcttatcgataccgtcaaacaaatcataaaaaatttatttgctttcaggaaaatttttctgtataatagattcaattgcgatgacgacgaacacgcattaaggaggtgaagagctcgaattcgagccaatatgcgagaacacccgagaaaattcatcgatgatggttgagatgtgtataagagacagctgtcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcga

SEQ ID NO: 238 - DNA, 70 bp, Artificial sequence
  Synthetic primer
aaaaacagcaacaatgtgagctttgttgtaattatattgtaaacatattgattccggggatccgtcgacc

SEQ ID NO: 239 - DNA, 68 bp, Artificial sequence
  Synthetic primer
aaacggagcctttcggctccgttattcatttacgcggcttcaactttcctgtaggctggagctgcttc

SEQ ID NO: 240 - DNA, 23 bp, Artificial sequence
  Synthetic primer
cgggcaggtgctatgaccaggac

SEQ ID NO: 241 - DNA, 23 bp, Artificial sequence
  Synthetic primer
cgcggcgttgaccggcagcctgg

SEQ ID NO: 242 - DNA, 70 bp, Artificial sequence
  Synthetic primer
atcattctcgtttacgttatcattcactttacatcagagatataccaatgattccggggatccgtcgacc

SEQ ID NO: 243 - DNA, 69 bp, Artificial sequence
  Synthetic primer
gcacggaaatccgtgccccaaaagagaaattagaaacggaaggttgcggttgtaggctggagctgcttc

SEQ ID NO: 244 - DNA, 21 bp, Artificial sequence
  Synthetic primer
caacagcaacctgctcagcaa

SEQ ID NO: 245 - DNA, 21 bp, Artificial sequence
  Synthetic primer
aagctggagcagcaaagcgtt

SEQ ID NO: 246 - DNA, 27 bp, Artificial sequence
  Synthetic primer
gctctcgagttagtaacagatgtcttc

SEQ ID NO: 247 - DNA, 27 bp, Artificial sequence
  Synthetic primer
gcggatccatggcaactgagtatgacg

SEQ ID NO: 248 - DNA, 32 bp, Artificial sequence
  Synthetic primer
ataaaccatggatccatgaacgagtacgcccc

SEQ ID NO: 249 - DNA, 33 bp, Artificial sequence
  Synthetic primer
ccaagcttcgaattctcagatatgcaaggcgtg

SEQ ID NO: 250 - DNA, 41 bp, Artificial sequence
  Synthetic primer
gaggaataaaccgtggcaacagaatatgatgtcgttattct

SEQ ID NO: 251 - DNA, 45 bp, Artificial sequence
  Synthetic primer
cccaagcttcgaattttaatacaatgctgtattttctttggaaat

SEQ ID NO: 252 - DNA, 36 bp, Artificial sequence
  Synthetic primer
tgaattccatggcgcaactcactcttcttttagtcg

SEQ ID NO: 253 - DNA, 39 bp, Artificial sequence
  Synthetic primer
cagtacctcgagtcttcgtatacatatgcgctcagtcac

SEQ ID NO: 254 - DNA, 21 bp, Artificial sequence
  Synthetic primer
ccttggggcatatgaaagctg

SEQ ID NO: 255 - DNA, 29 bp, Artificial sequence
  Synthetic primer
tttagtcatctcgagtgcacctcaccttt

SEQ ID NO: 256 - DNA, 37 bp, Artificial sequence
  Synthetic primer
gaggaataaaccatgaacgcaggaattttaggagtag

SEQ ID NO: 257 - DNA, 41 bp, Artificial sequence
  Synthetic primer
cccaagcttcgaattcttacttaccccaacgaatgattagg

SEQ ID NO: 258 - DNA, 35 bp, Artificial sequence
  Synthetic primer
tttcgcgaggccggccccgccaacacccgctgacg

SEQ ID NO: 259 - DNA, 39 bp, Artificial sequence
  Synthetic primer
aaggacgtcttaattaatcaggagagcgttcaccgacaa

SEQ ID NO: 260 - DNA, 24 bp, Artificial sequence
  Synthetic primer
cttaacttcatgtgaaaagtttgt

SEQ ID NO: 261 - DNA, 24 bp, Artificial sequence
  Synthetic primer
acaatacccatgtttatagggcaa

SEQ ID NO: 262 - DNA, 71 bp, Artificial sequence
  Synthetic primer
cctgacagtgcgggctttttttttcgaccaaaggtaacgaggtaacaaccgtgtaggctggagctgcttcg

SEQ ID NO: 263 - DNA, 62 bp, Artificial sequence
  Synthetic primer
gtatatattaatgtatcgattaaataaggaggaataaaccatgcgagtgttgaagttcggcg

SEQ ID NO: 264 - DNA, 59 bp, Artificial sequence
  Synthetic primer
ctgatgtaccgccgaacttcaacactcgcatggtttattcctccttatttaatcgatac

SEQ ID NO: 265 - DNA, 28 bp, Artificial sequence
  Synthetic primer
gcgcccgtattttcgtggtgctgattac

SEQ ID NO: 266 - DNA, 28 bp, Artificial sequence
  Synthetic primer
gtaatcagcaccacgtaaatacgggcgc

SEQ ID NO: 267 - DNA, 25 bp, Artificial sequence
  Synthetic primer
tcagactcctaacttccatgagagg

SEQ ID NO: 268 - DNA, 50 bp, Artificial sequence
  Synthetic primer
aatatttgccagaaccgttatgatgtcggcattccggggatccgtcgacc

SEQ ID NO: 269 - DNA, 55 bp, Artificial sequence
  Synthetic primer
cttcgaactgcaggtcgacggatccccggaatgccgacatcataacggttctggc

SEQ ID NO: 270 - DNA, 29 bp, Artificial sequence
  Synthetic primer
gctgatcattaactatccgctggatgacc

SEQ ID NO: 271 - DNA, 40 bp, Artificial sequence
  Synthetic primer
actggaaagcgggcagtgagcgcaacgcaattaatgtaag

SEQ ID NO: 272 - DNA, 16 bp, Artificial sequence
  Synthetic primer
tcactgcccgctttcc

SEQ ID NO: 273 - DNA, 55 bp, Artificial sequence
  Synthetic primer
accggcagatcgtatgtaatatgcatggtttattcctccttatttaatcgataca

SEQ ID NO: 274 - DNA, 23 bp, Artificial sequence
  Synthetic primer
atgcatattacatacgatctgcc

SEQ ID NO: 275 - DNA, 38 bp, Artificial sequence
  Synthetic primer
ggtcgacggatccccggaattaagcgtcaacgaaaccg

SEQ ID NO: 276 - DNA, 38 bp, Artificial sequence
  Synthetic primer
gaagcagctccagcctacaccagacgatggtgcaggat

SEQ ID NO: 277 - DNA, 21 bp, Artificial sequence
  Synthetic primer
gcaaagaccagaccgttcata

SEQ ID NO: 278 - DNA, 20 bp, Artificial sequence
  Synthetic primer
attccggggatccgtcgacc

SEQ ID NO: 279 - DNA, 20 bp, Artificial sequence
  Synthetic primer
tgtaggctggagctgcttcg

SEQ ID NO: 280 - DNA, 71 bp, Artificial sequence; identical to SEQ ID NO: 262
  Synthetic primer

SEQ ID NO: 281 - DNA, 62 bp, Artificial sequence; identical to SEQ ID NO: 263
  Synthetic primer

SEQ ID NO: 282 - DNA, 74 bp, Artificial sequence
  Synthetic primer
aaaaacagcaacaatgtgagctttgttgtaattatattgtaaacatattgtccgctgtttctgcattcttacgt

SEQ ID NO: 283 - DNA, 72 bp, Artificial sequence
  Synthetic primer
gatgacgacgaacacgcattaaggaggtgaataaggaggaataacatatgaaagctggcattcttggtgttg

SEQ ID NO: 284 - DNA, 72 bp, Artificial sequence
  Synthetic primer
gtaacgtccaacaccaagaatgccagctttcatatgttattcctccttattcacctccttaatgcgtgttcg

SEQ ID NO: 285 - DNA, 70 bp, Artificial sequence
  Synthetic primer
aaacggagcctttcggctccgttattcatttacgcggcttcaactttccgttatcggccccagcggattg

SEQ ID NO: 286 - DNA, 70 bp, Artificial sequence
  Synthetic primer
cgcagtttgcaagtgacggtatataaccgaaaagtgactgagcgtacatgattccggggatccgtcgacc

SEQ ID NO: 287 - DNA, 70 bp, Artificial sequence
  Synthetic primer
gcaaattgcgtcatgttttaatccttatcctagaaacgaaccagcgcggatgtaggctggagctgcttcg

SEQ ID NO: 288 - DNA, 20 bp, Artificial sequence
  Synthetic primer
gcagcgacaagttcctcagc

SEQ ID NO: 289 - DNA, 21 bp, Artificial sequence
  Synthetic primer
ccgcagaagcttcagcaaacg

SEQ ID NO: 290 - DNA, 23 bp, Artificial sequence
  Synthetic primer
cgggcaggtgctatgaccaggac

SEQ ID NO: 291 - DNA, 21 bp, Artificial sequence
  Synthetic primer
gggcaggataagctcgggagg

SEQ ID NO: 292 - DNA, 28 bp, Artificial sequence
  Synthetic primer
atatgacgtcggcatccgcttacagaca

SEQ ID NO: 293 - DNA, 32 bp, Artificial sequence
  Synthetic primer
aattcttaagtcaggagagcgttcaccgacaa

SEQ ID NO: 294 - DNA, 41 bp, Artificial sequence
  Synthetic primer
taaggaggaataaaccatgagtgaaacatacgtgtctgaga

SEQ ID NO: 295 - DNA, 47 bp, Artificial sequence
  Synthetic primer
cgggcccaagcttcgaattttattaggtcaagtattcgtactcaggg

SEQ ID NO: 296 - DNA, 55 bp, Artificial sequence; identical to SEQ ID NO: 269
  Synthetic primer

SEQ ID NO: 297 - DNA, 50 bp, Artificial sequence; identical to SEQ ID NO: 268
  Synthetic primer

SEQ ID NO: 298 - DNA, 68 bp, Artificial sequence
  Synthetic primer
gtatatattaatgtatcgattaaataaggaggaataaaccatgatggtaaggatatttgatacaacac

SEQ ID NO: 299 - DNA, 60 bp, Artificial sequence
  Synthetic primer
ctaagtgttgtatcaaatatccttaccatcatggtttattcctccttatttaatcgatac

SEQ ID NO: 300 - DNA, 66 bp, Artificial sequence
  Synthetic primer
gatttgttggctatagttagagaagttactggaaaattgtaacaaggaaaccgtgtgatgtcgaag

SEQ ID NO: 301 - DNA, 62 bp, Artificial sequence
  Synthetic primer
gtaattcttcgacatcacacggtttccttgttacaattttccagtaacttctctaactatag

SEQ ID NO: 302 - DNA, 22 bp, Artificial sequence
  Synthetic primer
ggtagcgaaggttttgcccggc

SEQ ID NO: 303 - DNA, 22 bp, Artificial sequence
  Synthetic primer
gattggtgccccaggtgacctg

SEQ ID NO: 304 - DNA, 72 bp, Artificial sequence
  Synthetic primer
gagttgcaacgcaaagctcaacacaacgaaaacaacaaggaaaccgtgtgagtgtaggctggagctgcttcg

SEQ ID NO: 305 - DNA, 19 bp, Artificial sequence
  Synthetic primer
cttccacggcgtcggcctg

SEQ ID NO: 306 - DNA, 41 bp, Artificial sequence; identical to SEQ ID NO: 250
  Synthetic primer

SEQ ID NO: 307 - DNA, 45 bp, Artificial sequence; identical to SEQ ID NO: 251
  Synthetic primer

SEQ ID NO: 308 - protein, 473 aa, Marinobacter hydrocarbonoclasticus
  MISC_FEATURE: ester synthase
MKRLGTLDASWLAVESEDTPMHVGTLQIFSLPEGAPETFLRDMVTRMKEAGDVAPPWGYKLAWSGFLGRVIAPAWKVDKDIDLDYHVRHSALPRPGGERELGILVSRLHSNPLDFSRPLWECHVIEGLENNRFALYTKMHHSMIDGISGVRLMQRVLTTDPERCNMPPPWTVRPHQRRGAKTDKEASVPAAVSQAMDALKLQADMAPRLWQAGNRLVHSVRHPEDGLTAPFTGPVSVLNHRVTAQRRFATQHYQLDRLKNLAHASGGSLNDIVLYLCGTALRRFLAEQNNLPDTPLTAGIPVNIRPADDEGTGTQISFMIASLATDEADPLNRLQQIKTSTRRAKEHLQKLPKSALTQYTMLLMSPYILQLMSGLGGRMRPVFNVTISNVPGPEGTLYYEGARLEAMYPVSLIAHGGALNITCLSYAGSLNFGFTGCRDTLPSMQKLAVYTGEALDELESLILPPKKRARTRK

SEQ ID NO: 309 - protein, 341 aa, Synechococcus elongatus
  MISC_FEATURE: acyl-ACP reductase
MFGLIGHLTSLEQARDVSRRMGYDEYADQGLEFWSSAPPQIVDEITVTSATGKVIHGRYIESCFLPEMLAARRFKTATRKVLNAMSHAQKHGIDISALGGFTSIIFENFDLASLRQVRDTTLEFERFTTGNTHTAYVICRQVEAAAKTLGIDITQATVAVVGATGDIGSAVCRWLDLKLGVGDLILTARNQERLDNLQAELGRGKILPLEAALPEADFIVWVASMPQGVVIDPATLKQPCVLIDGGYPKNLGSKVQGEGIYVLNGGVVEHCFDIDWQIMSAAEMARPERQMFACFAEAMLLEFEGWHTNFSWGRNQITIEKMEAIGEASVRHGFQPLALAI

SEQ ID NO: 310 - DNA, 22 bp, Artificial sequence
  Synthetic primer
ggctggctggcataaatatctc

SEQ ID NO: 311 - DNA, 69 bp, Artificial sequence
  Synthetic primer
gttatgatatgttggtcggataagcgtcgcgccgcatccgacattgattgcgagagcgttcaccgacaa

SEQ ID NO: 312 - protein, 232 aa, Nostoc punctiforme
  MISC_FEATURE: aldehyde decarbonylase (ADC)
MQQLTDQSKELDFKSETYKDAYSRINAIVIEGEQEAHENYITLAQLLPESHDELIRLSKMESRHKKGFEACGRNLAVTPDLQFAKEFFSGLHQNFQTAAAEGKVVTCLLIQSLIIECFAIAAYNIYIPVADDFARKITEGVVKEEYSHLNFGEVWLKEHFAESKAELELANRQNLPIVWKMLNQVEGDAHTMAMEKDALVEDFMIQYGEALSNIGFSTRDIMRLSAYGLIGA

SEQ ID NO: 313 - DNA, 22 bp, Artificial sequence
  Synthetic primer
ggctggctggcataaatatctc

SEQ ID NO: 314 - DNA, 79 bp, Artificial sequence
  Synthetic primer
gcgttaaagttgttctgcttcatcagcaggatatcctgcaccatcgtctggattttgaacttttgctttgccacggaac

SEQ ID NO: 315 - DNA, 8203 bp, Artificial sequence
  pSL67-87A plasmid
cactataccaattgagatgggctagtcaatgataattactagtccttttcctttgagttgtgggtatctgtaaattctgctagacctttgctggaaaacttgtaaattctgctagaccctctgtaaattccgctagacctttgtgtgttttttttgtttatattcaagtggttataatttatagaataaagaaagaataaaaaaagataaaaagaatagatcccagccctgtgtataactcactactttagtcagttccgcagtattacaaaaggatgtcgcaaacgctgtttgctcctctacaaaacagaccttaaaaccctaaaggcgtcggcatccgcttacagacaagctgtgaccgtctccgggagctgcatgtgtcagaggttttcaccgtcatcaccgaaacgcgcgaggcagcagatcaattcgcgcgcgaaggcgaagcggcatgcatttacgttgacaccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgttaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgatctggtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagcgccgctgagaaaaagcgaagcggcactgctctttaacaatttatcagacaatctgtgtgggcactcgaccggaattatcgattaactttattattaaaaattaaagaggtatatattaatgtatcgattaaataaggaggaataaaccatggcattcggtcttatcggtcatctcaccagtttggagcaggcccgcgacgtttctcgcaggatgggctacgacgaatacgccgatcaaggattggagttttggagtagcgctcctcctcaaatcgttgatgaaatcacagtcaccagtgccacaggcaaggtgattcacggtcgctacatcgaatcgtgtttcttgccggaaatgctggcggcgcgccgcttcaaaacagccacgcgcaaagttctcaatgccatgtcccatgcccaaaaacacggcatcgacatctcggccttggggggctttacctcgattattttcgagaatttcgatttggccagtttgcggcaagtgcgcgacactaccttggagtttgaacggttcaccaccggcaatactcacacggcctacgtaatctgtagacaggtggaagccgctgctaaaacgctgggcatcgacattacccaagcgacagtagcggttgtcggcgcgactggcgatatcggtagcgctgtctgccgctggctcgacctcaaactgggtgtcggtgatttgatcctgacggcgcgcaatcaggagcgtttggataacctgcaggctgaactcggccggggcaagattctgcccttggaagccgctctgccggaagctgactttatcgtgtgggtcgccagtatgcctcagggcgtagtgatcgacccagcaaccctgaagcaaccctgcgtcctaatcgacgggggctaccccaaaaacttgggcagcaaagtccaaggtgagggcatctatgtcctcaatggcggggtagttgaacattgcttcgacatcgactggcagatcatgtccgctgcagagatggcgcggcccgagcgccagatgtttgcctgctttgccgaggcgatgctcttggaatttgaaggctggcatactaacttctcctggggccgcaaccaaatcacgatcgagaagatggaagcgatcggtgaggcatcggtgcgccacggcttccaacccttggcattggcaatttgagaattcattccggggatccgtcgacctgcagttcgaagttcctattctctagaaagtataggaacttcagagcgcttttgaagctcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctaataaggggatcttgaagttcctattccgaagttcctattctctagaaagtataggaacttcgaagcagctccagcctacacgaattcgaagcttgggcccgaacaaaaactcatctcagaagaggatctgaatagcgccgtcgaccatcatcatcatcatcattgagtttaaacggtctccagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgacgcctgatgcggtattttctccttacgcatctgtgcggtatttcacaccgcatatggtgcactctcagtacaatctgctctgatgccgcatagttaagccagccccgacacccgccaacacccgctgacgagcttagtaaagccctcgctagattttaatgcggatgttgcgattacttcgccaactattgcgataacaagaaaaagccagcctttcatgatatatctcccaatttgtgtagggcttattatgcacgcttaaaaataataaaagcagacttgacctgatagtttggctgtgagcaattatgtgcttagtgcatctaacgcttgagttaagccgcgccgcgaagcggcgtcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactttgttttagggcgactgccctgctgcgtaacatcgttgctgctccataacatcaaacatcgacccacggcgtaacgcgcttgctgcttggatgcccgaggcatagactgtaccccaaaaaaacagtcataacaagccatgaaaaccgccactgcgccgttaccaccgctgcgttcggtcaaggttctggaccagttgcgtgagcgcatacgctacttgcattacagcttacgaaccgaacaggcttatgtccactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccagcttctgtatggaacgggcatgcggatcagtgagggtttgcaactgcgggtcaaggatctggatttcgatcacggcacgatcatcgtgcgggagggcaagggctccaaggatcgggccttgatgttacccgagagcttggcacccagcctgcgcgagcaggggaattaattcccacgggttttgctgcccgcaaacgggctgttctggtgttgctagtttgttatcagaatcgcagatccggcttcagccggtttgccggctgaaagcgctatttcttccagaattgccatgattttttccccacgggaggcgtcactggctcccgtgttgtcggcagctttgattcgataagcagcatcgcctgtttcaggctgtctatgtgtgactgttgagctgtaacaagttgtctcaggtgttcaatttcatgttctagttgctttgttttactggtttcacctgttctattaggtgttacatgctgttcatctgttacattgtcgatctgttcatggtgaacagctttgaatgcaccaaaaactcgtaaaagctctgatgtatctatcttttttacaccgttttcatctgtgcatatggacagttttccctttgatatgtaacggtgaacagttgttctacttttgtttgttagtcttgatgcttcactgatagatacaagagccataagaacctcagatccttccgtatttagccagtatgttctctagtgtggttcgttgtttttgcgtgagccatgagaacgaaccattgagatcatacttactttgcatgtcactcaaaaattttgcctcaaaactggtgagctgaatttttgcagttaaagcatcgtgtagtgtttttcttagtccgttatgtaggtaggaatctgatgtaatggttgttggtattttgtcaccattcatttttatctggttgttctcaagttcggttacgagatccatttgtctatctagttcaacttggaaaatcaacgtatcagtcgggcggcctcgcttatcaaccaccaatttcatattgctgtaagtgtttaaatctttacttattggtttcaaaacccattggttaagccttttaaactcatggtagttattttcaagcattaacatgaacttaaattcatcaaggctaatctctatatttgccttgtgagttttcttttgtgttagttcttttaataaccactcataaatcctcatagagtatttgttttcaaaagacttaacatgttccagattatattttatgaatttttttaactggaaaagataaggcaatatctcttcactaaaaactaattctaatttttcgcttgagaacttggcatagtttgtccactggaaaatctcaaagcctttaaccaaaggattcctgatttccacagttctcgtcatcagctctctggttgctttagctaatacaccataagcattttccctactgatgttcatcatctgagcgtattggttataagtgaacgataccgtccgttctttccttgtagggttttcaatcgtggggttgagtagtgccacacagcataaaattagcttggtttcatgctccgttaagtcatagcgactaatcgctagttcatttgctttgaaaacaactaattcagacatacatctcaattggtctaggtgattttaat

What is claimed is:

1. A recombinant microbial cell comprising:
   (a) polynucleotides encoding a branched chain alpha-keto acid dehydrogenase (BKD) complex which comprises polypeptides having branched-chain alpha-keto acid dehydrogenase activity, lipoamide acyltransferase activity, and dihydrolipoamide dehydrogenase activity,
   (b) a polynucleotide encoding a polypeptide having beta-ketoacyl-ACP synthase activity that utilizes a branched acyl-CoA molecule as a substrate,
   (c) one or more polynucleotides encoding a polypeptide having fatty acid derivative enzyme activity, wherein the fatty acid derivative enzyme activity comprises one or more of thioesterase activity, fatty alcohol biosynthetic activity, ester synthase activity and hydrocarbon biosynthetic activity, and
   (d) one or more polynucleotides encoding a polypeptide having aspartokinase activity, homoserine dehydrogenase activity, homoserine kinase activity, threonine synthase activity or threonine deaminase activity,
   wherein at least one polynucleotide according to (a), (b) or (d), encodes a polypeptide that is exogenous to the recombinant microbial cell or wherein expression of at least one polynucleotide according to (a), (b) or (d), is modulated in the recombinant microbial cell as compared to the expression in a corresponding wild-type microbial cell, and
   wherein the recombinant microbial cell produces a branched fatty acid derivative when cultured in the presence of a carbon source under conditions effective to express the polynucleotides.

2. The recombinant microbial cell of claim 1, further comprising (e) one or more polynucleotides encoding a polypeptide having (R)-citramalate synthase activity, isopropylmalate isomerase activity, or beta-isopropylmalate dehydrogenase activity.

3. The recombinant microbial cell of claim 1, which produces a fatty acid derivative composition comprising straight-chain fatty acid derivatives and branched fatty acid derivatives, wherein at least 5% of the fatty acid derivatives in the composition are branched fatty acid derivatives, when cultured in the presence of a carbon source under conditions effective to express the polynucleotides.

4. The recombinant microbial cell of claim 1, which produces at least 25 mg/L branched fatty acid derivatives when cultured in the presence of a carbon source under conditions effective to express the polynucleotides.

5. The recombinant microbial cell of claim 1, wherein the recombinant microbial cell produces a fatty acid derivative composition comprising straight-chain fatty acid derivatives and branched fatty acid derivatives, wherein at least 10% of the branched fatty acid derivatives in the composition are anteiso-branched fatty acid derivatives.

6. The recombinant microbial cell of claim 1, which comprises an endogenous polynucleotide sequence encoding a polypeptide having beta-ketoacyl-ACP synthase activity that does not utilize a branched acyl-CoA molecule as a substrate, wherein expression of the endogenous polynucleotide sequence encoding a polypeptide having beta-ketoacyl-ACP synthase activity in the recombinant microbial cell is attenuated.

7. The recombinant microbial cell of claim 1, wherein the recombinant microbial cell is a member of the genus *Escherichia, Bacillus, Lactobacillus, Pantoea, Zymomonas, Rhodococcus, Pseudomonas, Aspergillus, Trichoderma, Neurospora, Fusarium, Huinicola, Rhizomucor, Kluyveromyces, Pichia, Mucor, Myceliophtora, Penicillium, Phanerochaete, Pleurotus, Trametes, Chrysosporium, Saccharomyces, Stenotrophamonas, Schizosaccharomyces, Yarrowia, Streptomyces, Synechococcus, Chlorella*, or *Prototheca*.

8. The recombinant microbial cell of claim 4, wherein the fatty acid derivative enzyme activity comprises one or more of thioesterase activity, fatty alcohol biosynthetic activity, ester synthase activity and hydrocarbon biosynthetic activity, wherein the branched fatty acid derivative is a branched fatty acid, a branched fatty alcohol, a branched fatty ester or a branched hydrocarbon.

9. The recombinant microbial cell of claim 5, wherein the fatty acid derivative enzyme activity comprises one or more of thioesterase activity, fatty alcohol biosynthetic activity, ester synthase activity and hydrocarbon biosynthetic activity, and wherein the branched fatty acid derivatives include an anteiso-branched fatty acid, an anteiso branched fatty alcohol, an anteiso branched fatty ester or an anteiso branched hydrocarbon.

10. The recombinant microbial cell of claim 9, which produces at least 10 mg/L of an anteiso-branched fatty acid derivative.

11. A cell culture comprising the recombinant microbial cell of claim 1.

12. A method of making a composition comprising an anteiso-branched fatty acid derivative, the method comprising:
   obtaining the recombinant microbial cell of claim 1,
   culturing the recombinant microbial cell in a culture medium containing a carbon source under conditions effective to express the polynucleotides and produce a fatty acid derivative composition comprising straight-chain fatty acid derivatives and branched fatty acid derivatives wherein at least 10% of the branched fatty acid derivatives in the composition are anteiso-branched fatty acid derivatives, and
   optionally recovering the composition from the culture medium.

13. The method of claim 12, wherein the branched fatty acid derivative composition produced in the culture medium comprises at least 10 mg/L anteiso-branched fatty acid derivatives.

14. The method of claim 12, wherein the recombinant microbial cell expresses one or more polypeptides having a fatty acid derivative enzyme activity selected from the group consisting of:
   (1) a polypeptide having thioesterase activity;
   (2) a polypeptide having decarboxylase activity;
   (3) a polypeptide having carboxylic acid reductase activity;
   (4) a polypeptide having alcohol dehydrogenase activity (EC 1.1.1.1);
   (5) a polypeptide having aldehyde decarbonylase activity (EC 4.1.99.5);
   (6) a polypeptide having acyl-CoA reductase activity (EC 1.2.1.50);
   (7) a polypeptide having acyl-ACP reductase activity;
   (8) a polypeptide having ester synthase activity (EC 3.1.1.67);
   (9) a polypeptide having OleA activity; and
   (10) a polypeptide having OleCD or OleBCD activity;
   wherein the recombinant microbial cell produces a composition comprising one or more of anteiso-branched fatty acids, anteiso-branched fatty esters, anteiso-branched wax esters, anteiso-branched fatty aldehydes, anteiso-branched fatty alcohols, anteiso-branched alkanes, anteiso-branched alkenes, anteiso-branched internal olefins, anteiso-branched terminal olefins, and anteiso-branched ketones.

* * * * *